United States Patent
Frommer et al.

(10) Patent No.: US 9,562,081 B2
(45) Date of Patent: Feb. 7, 2017

(54) SUGAR TRANSPORTERS

(75) Inventors: Wolf B. Frommer, Stanford, CA (US); Sylvie Lalonde, Stanford, CA (US)

(73) Assignee: CARNEGIE INSTITUTION OF WASHINGTON, Washington, DC (US)

( * ) Notice: Subject to any disclaimer, the term of this patent is extended or adjusted under 35 U.S.C. 154(b) by 141 days.

(21) Appl. No.: 12/773,500

(22) Filed: May 4, 2010

(65) Prior Publication Data

US 2011/0209248 A1 Aug. 25, 2011

Related U.S. Application Data

(60) Provisional application No. 61/175,267, filed on May 4, 2009.

(51) Int. Cl.
| | |
|---|---|
| *C12N 15/113* | (2010.01) |
| *C12N 15/82* | (2006.01) |
| *C07K 14/47* | (2006.01) |
| *C07K 14/415* | (2006.01) |
| *C07K 14/435* | (2006.01) |

(52) U.S. Cl.
CPC ............ *C07K 14/47* (2013.01); *C07K 14/415* (2013.01); *C07K 14/43545* (2013.01); *C12N 15/8246* (2013.01)

(58) Field of Classification Search
None
See application file for complete search history.

(56) References Cited

U.S. PATENT DOCUMENTS

| | | | |
|---|---|---|---|
| 7,989,676 B2 * | 8/2011 | Troukhan et al. ............ 800/278 |
| 2003/0233670 A1 | 12/2003 | Edgerton et al. | |
| 2008/0090998 A1 * | 4/2008 | Abad .................... | C07K 14/415 536/23.1 |

FOREIGN PATENT DOCUMENTS

| | | |
|---|---|---|
| CN | 1861791 A | 11/2006 |
| EP | 0974667 | 1/2000 |
| WO | 99/45118 | 9/1999 |

OTHER PUBLICATIONS

Chen, Q.L., B.H. Hou, S. Lalonde, H. Takanaga, M.L. Hartung, X.Q. Qu, W.J. Guo, J.G. Kim, W. Underwood, B. Chaudhuri, D. Chermak, G. Antony, F.F. White, S.C. Somerville, M.B. Mudgett, and W.B. Frommer. 2010. Sugar transporters for intercellular exchange and nutrition of pathogens. Nature. 468:527-534.*
Chen, Q.L., X.Q. Qu, B.H. Hou, D. Sosso, S. Osorio, A.R. Fernie, and W.B. Frommer. 2012. Sucrose efflux mediated by SWEET proteins as a key step for phloem transport. Science. 335:207-211.*
Ge, Y.X., G.C. Angenent, E. Dahlhaus, J. Franken, J. Peters, G.J. Wullems, and J. Creemers-Molenaar. 2001. Partial silencing of the NEC1 gene results in early opening of anthers in Petunia hybrida. Mol Genet Genomics. 265:414-423.*
Graham, L.E., L.W. Wilcox, M.E. Cook, and P.G. Gensel. 2004. Resistant tissues of modern marchantioid liverworts resemble enigmatic Early Paleozoic microfossils. PNAS. 101(30):11025-11029.*
Yang, B., A. Sugio, and F.F. White. 2006. Os8N3 is a host disease-susceptibility gene for bacterial blight of rice. PNAS. 103(27):10503-10508.*
Sutton et al. 1999. Glucose, and not sucrose, is transported from wheat to wheat powdery mildew. Planta. 208:426-430.*
Alonso et al. 2003. Genome-wide insertional mutagenesis of Arabidopsis thaliana. Science. 301:653-657.*
Alonso et al. 2003. Genome-wide insertional mutagenesis of Arabidopsis thaliana. Science. 301:653-657. Supplemental information. Single page.*
Yang et al., "Os8N3 is a host disease-susuceptibility gene for bacterial blight of rice," PNAS, 103(27):10503-10508 (2006).
Ge et al., "NEC1, a novel gene, highly expressed in nectary tissue of Petunia hybrida," Plant Journal, 24(6)125-734 (2000).
De Paepe et al., "Transcriptional profiling by cDNA-AFLP and microarray analysis reveals novel insights into the early response to ethylene in Arabidopsis," Plant Journal, 39(4):537-559 (2004).
Tagoh et al., "Molecular cloning and characterization of a novel stromal cell-derived cDNA encoding a protein that facilitates gene activation of recombination activating gene (RAG)-1 in human lymphoid progenitors," Biochem Biophys Res Commun., 221(3):744-749 (1996).
Chaudhuri et al., "Protonophore- and pH-insensitive glucose and sucrose accumulation detected by FRET nanosensors in Arabidopsis root tips," Plant Journal, 56(6):948-962 (2008).
Guan et al., "Ruptured Pollen Grain1, a member of the MtN3/saliva gene family, is crucial for exine pattern formation and cell integrity of microspores in Arabidopsis," Plant Physiology,147(2):852-863 (2008).

\* cited by examiner

*Primary Examiner* — Jason Deveau Rosen
(74) *Attorney, Agent, or Firm* — Womble Carlyle Sandridge & Rice LLC

(57) ABSTRACT

A novel class of transporter protein, referred to as SWEET, GLUE or Glü, is disclosed. These transporters provide a novel system for the transportation of sugars across membranes within a cell and between the inside and outside of a cell. Such transporters are useful for understanding and altering the sugar concentration within certain organs of an organism, and within certain organelles within the cell. These transporters are also useful in protecting plants from a pathogen attack.

22 Claims, 59 Drawing Sheets

Figure 44

>CeK02D7_5 (SEQ ID NO: 127)
MLEVVLQVLSISAITTTIALFFCGIPICMQIRRQGAVGDISGVPFLMGVLGGSFWLRYGL
LKMDYVMIIVNVVGVACMAFYCVFFLIYSLPKKTFTCQLILVTSTIGGMVLWIALKPNLD
YLGVICMTFNIMNFGAPLAGLGVVLKNREVSTLPLPMCVANFLVSSQWCLYGNLVSDIYI
IIPNGIGMFLAIVQLALFVVLPIRENEKSPLEKLASWFTGRDSKVKDLERGDCIVSSPPS
SPQKVPNETRSDVEDKFDKLMAETSSTIPSDSRRGSMGSPPSYKSRSSSDPDLSSIQSP

>CeC54F6_4 (SEQ ID NO: 128)
MDTFFPIIFSTELKKPICLQIYRQGHVGDISGFPFLMGTLVLPFWLRYGFLRNDVMLISI
NCAGIPIAVFNAMFFLYFSKPKKYYMTQLSIVTIIILTMLMLIHFNPNVQFLGFVCIVLN
LITFGSPLAGLRVVLRDREVITLPFVLCLVQLIVQCLWNLYGILIQDFFLVIPTAVGIMI
SLVQLSLFLIFPRKRDGYSPMAKVARCVFGSSNNRKEVPDEPQKIVVESNTVY

>CeC06G8_1 (SEQ ID NO: 129)
MFEIFTQGFSLLNLLSILAFFTTVGLFFCGIPICRQIWKRKDTKEISGAPFLMGVVGGCC
WMTYGWLKNDGTVKWVTGCQVILYTTYTIFYWCMTKKKLYISLKVLGVIGICTSLVLAVH
FFGMKIFHPLGIVCLTLNIADFAAPLGGIRVVIRRWATSTLPLPLCIANFLVSTEWFLYG
LLKNDFYLIFPNGVGSLLAFIQLLLFIVLPRKPGQRAPIVRLWLWIRGVRVEETKEIVAE
LGECDEKDKKMNRAQRWSQKIKMNVSTVAEELENVIYQLPTKDQFAYTHKIGDEDSSSE
KTVETVDETKKAPVTAVDKLKDADRERKMRNALRAAQDARENALRRTISSPDLSE
MEAGGVADSFLSSACVLFTLGMFSTGLSDLRHMQRTRSVDNIQFLPFLTTDVNNLSWLSY
GVLKGDGTLIIVNSVGAVLQTLYILAYLHYSPQKHGVLLQTATLLAVLLGYGYFWLLVP
DLEARLQQLGLFCSVFTISMYLSPLADLAKIVQTKSTQRLSFSLTIATLFCSASWSIYGF
RLRDPYIAVPNLPGILTSLIRLGLFCKYPPEQDRKYRLLQT

>RnRAG1_AP1 (SEQ ID NO: 130)
MEAGGVADSFLSSACVLFTLGMFSTGLSDLRHMQRTRSVDNIQFLPFLTTDVNNLGWLSY
GVLKGDGTLIIVNTVGAVLQTLYILAYLHYSPQKHAVLLQTATLLAVLLGYGYFWLLVP
DLETRLQQLGLFCSVFTISMYLSPLADLAKIIQTKSTQRLSFSLTIATLLSSTSWSIYGF
RLKDPYITVPNLPGILTGFIRLVLFYKYPPEQDTKYRLLQT

Figure 44, Continued

>HsRAG1_AP1 (SEQ ID NO: 131)
MEAGGFLDSLIYGACVVFTLGMFSAGLSDLRHMRMTRSVDNVQFLPFLTTEVNNLGWLSY
GALKGDGILIVVNTVGAALQTLYILAYLHYCPRKRVVLLQTATLLGVLLLGYGYFWLLVP
NPEARLQQLGLFCSVFTISMYLSPLADLAKVIQTKSTQCLSYPLTIATLLTSASWCLYGF
RLRDPYIMVSNFPGIVTSFIRFWLFWKYPQEQDRNYWLLQT

>XlRAG1_AP1 (SEQ ID NO: 132)
MDWMWLLSGACIVFTLGMFSSGLSDLRVMVAQRSVENIQYLPFLTTDLNNLGWFYYGYLK
GDGTLMIVNIGASLQSLYMGAYLLYSPERRYVGSQVLVSLGVLLGYCYFTLWILDLNS
RLNQLGLFCSVFTISMYLSPLADLAQIIRSKSTKCLSFPLTVATFLTSSSWVLYGLVQSD
LYITVPNFPGIVTSLVRFWLFSQFPPDPPTYRLLQA

>DrRAG1_AP1 (SEQ ID NO: 133)
MFTTGLTDLKKMKATQSADNVQFLPFLTTCLNNLGWLYYGLLKGDGTVIFVNIIGAFLQT
VYIATYCHYTKEKRRVYTQTLLMVSVLCVAWVYFSLVISPGEAQLSQLGLTCSVFTISMY
LSPLADLLDIMRTKSVERLSFSLTVATFFTSTSWTLYGLQLGDYYIMVPNTPGIFTSLIR
FFLFWWFGAVIPQIPSYKLIQI

>CiSWEa (SEQ ID NO: 134)
MAEFWISFFSNGCIAVTIIMFATGIPQCMEMMKKKTTKNIPFLPYLITNVNAIGWIIYGK
MTVNFTVVFVNTIGAGLQTLYMAVYIFFAADKSKPLVQSSVCGGAAAITWYIITQFANVI
DAINVTGIICCTVTIFMFASPLAEINTVIANKSTATISLPLTVTASLCSAMWTMFGLVLH
DNFIIIPNVLGFFAAFSRFYLFYKYPSSPGLPHSVX

>MtC10424_GC (SEQ ID NO: 39)
MAMTRESWAFVFGIIGNIISFAVFLSPLPTFYVIFKKKSAEGFQALPYVVALFSAMLWIY
YAFVKRESALLLITINTFGIVVESAYIIMFLIYAPKKQRLSTIKLLLLNVFGFGAMLLS
TLYLSKGAKRLAIIGWICLVFNISVFAAPLFVISKVIRSRSVEYMPFFLSFFLTINAVMW
FFYGLLLRDYYVALPNTLGFVFGIIQMVVYLIYRNATPVVEAPMKGQELSGGHIIDVVKI
GTDPNRAGGGAGSKV

Figure 44, Continued

>CT954252 (SEQ ID NO: 40)
MDVLFLTIGNVISCMTFLAPLPTFYRIYKKKSTEGFQSVPYVTALLSSAMLVI
ATLLLLTINIYGFGIEAIYIIFLLYASNKARLSTIKLLFLTVCGYGTMVILTTYI
KRLSIIGWICMVFNICVFASPLFILKQVIKTKSVAFMPLNLSFFLTLNAIVWF
DFYIAIPNTLGFVFGIVQMVIYLIYKDAIPLESTKLQKPNDHVLNICEDVPN(
QVVKSGAPAVAVIGDEDPNNGK
>AT5G50790 (SEQ ID NO: 9)
MAISQAVLATVFGILGNIIISFFVCLAPIPTFVRIYKRKSSEGYQSIPYVISLF;
YAMIKKDAMMLITINSFAFVVQIVYISLFFFYAPKKEKTLTVKFVLFVDVLGFGAIFVLT
YFIIHANKRVQVLGYICMVFALSVFVAPLGIIRKVIKTKSAEFMPFGLSFFLTLSAVMWF
FYGLLLKDMNIALPNVLGFIFGVLQMILFLIYKKPGTKVLEPPGIKLQDISEHVVDVVRL
STMVCNSQMRTLVPQDSADMEATIDIDEKIKGDIEKNKDEKEVFLISKN
>Mt7g005250 (SEQ ID NO: 135)
MAISHNTLAFAFGMLGNVISFMVFLAPMTTFYRIYKKKSTEGFQSLPYLVALFSSMLWLY
YAFLKKDEFLLTITNSFGCVVELIYILYIIYATKDARKLTIKLLLAMNIGSFGLILVT
KYAVHGPIRVQVLGWICVSISVSVFAAPLTIVAQVVRTKSVEFMPFNLSFTLTLSAIMWF
GYGLFLKDICIALPNVLGFALGLVQMILYCIYRNGDKKANSKAALKSVVIESSLGGTGE
VFQVEKNDGEEEEKKTIEETEYDSKV
>Mt5g076470 (SEQ ID NO: 136)
MDPHDHDRLAFIFGILGNIISSMVYLAPLPTFYRIWKKKSTEGFQSLPYLVALFSSMLWL
YYGFVKKHAFLLITINSAGCVIETIYIVTYLIYATKDARILTIKLFMAMNVACSVLIVLT
TQLAMHGKLRVHVLGWICTSFAICVFAAPLTIMAKVIRTKSVEFMPINLSFFLTLSAIVW
FFYGLLLHDICIAIPNVLGFILGLLQMLLYAIYNKSVKEEYALEPMTNIVIVNPLGIPCE
VFSLPVIDNVNKIEKEGAEEMEKSVENLT
>Mt2g008040 (SEQ ID NO: 137)
MAMISMNHHFLVIAFGLLGNIISCMVYLAPLPTFIQIYKKSTECFQSLPYLVALFSSML
WLYYGIQTNAIFIVSINAFGCVIEIIYCIMYIAYATKDARKLTIKLCAALNVVSFVLIFL
IIQFSIPENHRVQVLGWICTSISISVFAAPLSIVVRVRVKTKSVEFMPFNLSLFLTLSAVV
WFLYGFVKRDICIYLPNVVGFILGIIQMVLYGYYSKYSVEKEKEQAVINIVVNPLGSSE
VFPIPLDENKESIEDVINQQFQVKKVGEEDAKEKHDNNVEAIEFQCVV

Figure 44, Continued

>AT5G13170 (SEQ ID NO: 3)
MGVMINHHFLAFIFGILGNVISFLVFLAPVPTFYRIYKRKSTESFQSLPYQVSLFSCMLW
LYYALIKKDAFLLITINSFGCVVETLYIAMFFAYATREKRISAMKLFIAMNVAFFSLILM
VTHFVVKTPPLQVSVLGWICVAISVSVFAAPLMIVARVIKTKSVEYMPFTLSFFLTISAV
MWFAYGLFLNDICIAIPNVVGFVLGLLQMVLYLVYRNSNEKPEKINSSEQQLKSIVVMSP
LGVSEVHPVVTESVDPLSEAVHHEDLSKVTKVEEPSIENGKCYVEATRPETV

>Mt3g150940 (SEQ ID NO: 138)
MSSHHSHLSFAFGVLGNISSFVCFLAPLPTFYRICKKKSTEGFQSIPYVAALFSAMLWMF
YAYTKKGETLLITINAFGCVIETIYLAVFVTYCPKKVRMSTLRMIVLMNFVGFGTIVLLT
HFLAKQEEGRIKLLGWICVVFATSVFAAPLSIIRVVIRTKSVEFLPFPLSVLLLISAVMW
LLYGLSLRDIYVTLPNVVGLTFGIVQITLYAMYRNSKPVIDEKLPEHKGDIVDKEIENVV
VPSKTTNDEKKLEVSVVDMVIVEKKEEKQDEEHDEKEKKQDQVTQDKTKVKNENDNININ
KTEEKDSGCEV

>TC115479 (SEQ ID NO: 37)
MVHRDNTAIFVVGILGNIASFFCFIAPVSIFYQVCKKKTTGGFQSAPYVAALFSAMLWIF
YAYIKTGEMLIITINAFGCVIETIYLVIYTTYCSKKARIFTLKLIGLFNLGGICLVIILT
HVLAKERTERIELLGWICVVLSTSVFAAPLSVMRVVIRTKSVEFMPFTLSLLLTTSAIIW
LCYGILLKDIFVTLPNFVGITFGTIQMVLYAIYRKNKPVNDQKLPEHKDDMNENQLQVVV
IPLQNVVDIETTMENKEEKQEETKPSEGNQVQQQKEG

>AT5G50800 (SEQ ID NO: 6)
MALTNNLWAFVFGILGNIISFVVFLAPVPTFVRICKKKSTEGFQSLPYVSALFSAMLWIY
YAMQKDGTAFLLITINAFGCVIETIYIVLFVSYANKKTRISTLKVLGLLNFLGFAAIVLV
CELLTKGSTREKVLGGICVGFSVSVFAAPLSIMRVVVRTRSVEFMPFSLSLFLTISAVTW
LFYGLAIKDFYVALPNVLGAFLGAVQMILYIIFKYYKTPVAQKTDKSKDVSDHSIDIAKL
TTVIPGAVLDSAVHQPPALHNVPETKIQLTEVKSQNMTDPKDQINKDVQKQSQV

>AT4G25010 (SEQ ID NO: 5)
MVLTHNVLAVTFGVLGNIISFIVFLAPVPTFVRICKKKSIEGFESLPYVSALFSAMLWIY
YALQKDGAGFLLITINAVGCFIETIYIILFITYANKKARISTLKVLGLLNFLGFAAIILV
CELLTKGSNREKVLGGICVGFSVCVFAAPLSIMRVVIRTKSVEFMPFSLSLFLTISAITW
LFYGLAIKDFYVALPNILGAFLGAVQMILYVIFKYYKTPLVVDETEKPKTVSDHSINMVK
LSSTPASGDLTVQPQTNPDVSHPIKTHGGDLEDQMDKKMPN

Figure 44, Continued

>AT3G48740 (SEQ ID NO: 8)
MSLFNTENTWAFVFGLLGNLISFAVFLSPVPTFYRIWKKKTTEGFQSIPYVVALFSATLW
LYYATQKKDVFLLVTINAFGCFIETIYISMFLAYAPKPARMLTVKMLLLMNFGGFCAILL
LCQFLVKGATRAKIIGGICVGFSVCVFAAPLSIIRTVIKTRSVEYMPFSLSLTLTISAVI
WLLYGLALKDIYVAFPNVLGFALGALQMILYVVYKYCKTSPHLGEKEVEAAKLPEVSLDM
LKLGTVSSPEPISVVRQANKCTCGNDRRAEIEDGQTPKHGKQSSSAAAT

>AT5G23660 (SEQ ID NO: 7)
MALFDTHNTWAFVFGLLGNLISFAVFLSPVPTFYRICKKKTTEGFQSIPYVVALFSAMLW
LYYATQKKDVFLLVTINSFGCFIETIYISIFVAFASKKARMLTVKLLLLMNFGGFCLILL
LCQFLAKGTTRAKIIGGICVGFSVCVFAAPLSIIRTVIKTKSVEYMPFSLSLTLTISAVI
WLLYGLALKDIYVAFPNVIGFVLGALQMILYVVYKYCKTPSDLVEKELEAAKLPEVSIDM
VKLGTLTSPEPVAITVVRSVNTCNCNDRNAEIENGQGVRNSAATT

>AT2G39060 (SEQ ID NO: 10)
MFLKVHEIAFLFGLLGNIVSFGVFLSPVPTFYGIYKKKSSKGFQSIPYICALASATLLLY
YGIMKTHAYLIISINTFGCFIEISYLFLYILYAPREAKISTLKLIVICNIGGLGLLILV
NLLVPKQHRVSTVGWVCAAYSLAVFASPLSVMRKVIKTKSVEYMPFLLSLSLTLNAVMWF
FYGLLIKDKFIAMPNILGFLFGVAQMILYMMYQGSTKTDLPTENQLANKTDVNEVPIVAV
ELPDVGSDNVEGSVRPMK

>NEC1 (SEQ ID NO: 21)
MAQLRADDLSFIFGLLGNIVSFMVFLAPVPTFYKIYKRKSSEGYQAIPYMVALFSAGLLL
YYAYLRKNAYLIVSINGFGCAIELTYISLFLFYAPRKSKIFTGWLMLLELGALGMVMPIT
YLLAEGSHRVMIVGWICAAINVAVFAAPLSIMRQVIKTKSVEFMPFTLSLFLTLCATMWF
FYGFFKKDFYIAFPNILGFLFGIVQMLLYFVYKDSKRIDDEKSDPVREATKSKEGVEIII
NIEDDNSDNALQSMEKDFSRLRTSK

>Mt5g099910 (SEQ ID NO: 139)
MVTKMVWLDPNEVNEISMDNSRIVTFMSFLAPLPTFYSIYKKKSSEGFHSIPYVVTLLST
LLFVYYGFLKTNAIFLITINSIGCVMEVAYLIMYITYAPKKLKISTLVLILIVDMGGFGL
TMIITTFIVKGSFHVQVVGMICTIFNIGMFAAPLSIMKKVIKTRSVEYMPFPLSLFLTIC
ATMWFFYGFFDKDKYIMLPNGLGFLLGVSQMILYLIYKNAKNNVEASSTNQLQEHGCDGG
NNQIFPTVVEMKEINIV

Figure 44, Continued

>Os12g29220 (SEQ ID NO: 54)
MAGLSLQHPWAFAFGLLGNLISFTTYLAPIPTFYRIYKSKSTEGFQSVPYVVALFSAMLW
IFYALIKSNEALLITINAAGCVIETIYIVMYLAYAPKKAKVFTTKILLLLNVGVFGVILL
LTLLLSHGEQRVVSLGWVCVAFSVSVFVAPLSIIKRVIQSRSVEYMPFSLSLTLTLSAVV
WFLYGLLIKDKYVALPNILGFTFGVVQMGLYVFYMNATPVAGEGKEGKGKLAAAEELPVV
VNVGKLAAATPDRSTGAVHVHPVPRSCAAEAAAAEPEVLVDIPPPPPRAVEVAAV

>Os08g42350 (SEQ ID NO: 50)
MAGGFLSMANPAVTLSGVAGNIISFLVFLAPVATFLQVYKKKSTGGYSSVPYVVALFSSV
LWIFYALVKTNSRPLLTINAFGCGVEAAYIVLYLVYAPRRARLRTLAFFLLLDVAAFALI
VVTTLYLVPKPHQVKFLGSVCLAFSMAVFVAPLSIIFKVIKTKSVEFMPIGLSVCLTLSA
VAWFCYGLFTKDPYVMYPNVGGFFFSCVQMGLYFWYRKPRNTAVLPTTSDSMSPISAAAA
ATQRVIELPAGTHAFTILSVSPIPILGVHKVEVVAAEQAADGVAAAAADKELLQNKPEV
IEITAAV

>Os03g22590 (SEQ ID NO: 140)
MVQALVFAVGIVGNILSFLVILAPVPTFYRVYKKKSTESFQSVPYAVALLSAMLWLYYAL
LTSDLLLLSINSIGCLVESLYLTVYLLYAPRQAMAFTLKLVCAMNLALFAAVVAALQLLV
KATDRRVTLAGGIGASFALAVFVAPLTIIRQVIRTKSVEFMPFWLSFFLTLSAVVWFFYG
LLMKDFFVATPNVLGLLFGLAQMVLYVVYKNPKKNSAVSEAAAAQQVEVKDQQQLQMQLQ
ASPAVAPLDVDADADADLEAAAPATPQRPADDDAIDHRSVVVDIPPPPQPPPALPAVEVA

>Mt6g033410 (SEQ ID NO: 141)
MSVFASLAICKVAKDAAGVAGNIFAFGLFVSPIPTFRRIIRNGSTEMFSGLPYIYSLMNC
LICMWYGTPLISHDNILVTTVNSIGAVFQFVYIILFMMSAEKEKKVKMLAWLMGVLGIFA
IILIGSLQIDDIVMRRLFVGILSCASLISMFASPLFIIKLVIQTKSVEFMPFYLSLSTFL
MSTSFLVYGLLSDDIFIYVPNGIGTILGMTQLILYFYYESKSRRMDAEEPLIVSYA

>Mt5g007230 (SEQ ID NO: 142)
MSLFNAYSICEIGKDAAGIAGNIFAFGLFVSPIPTFRRIMRNGSTELFSGLPYIYSLLNC
LICLWYGTPLISCDNLLVTTVNSIGAAFQLVYIFLFLIYAEKPKKVRMFGLLLAVLGIFV
IILVGSLKITDSSIRRILVGCLSCASLISMFASPLFIIKLVIRTKSVEFMPFYLSFSTFL
MSISFFLYGLLSDDAFIYVPNGIGTVLGMIQLILYFYYKRSSSDDSTEPLIVSYG

Figure 44, Continued

>AT3G14770 (SEQ ID NO: 19)
MDVFAFNASLSMCKDVAGIAGNIFAFGLFVSPMPTFRRIMRNKSTEQFSGLPYIYALLNC
LICLWYGTPFISHSNAMLMTVNSVGATFQLCYIILFIMHTDKKNKMKMLGLLFVFAVVG
VIVAGSLQIPDQLTRWYFVGFLSCGSLVSMFASPLFVINLVIRTKSVEFMPFYLSLSTFL
MSASFLLYGLFNSDAFVYTPNGITILGIVQLALYCYYHRNSIEEETKEPLIVSYV

>Os01g36070.1 (SEQ ID NO: 82)
MMNALGLSVAATSTGSPFHDVCCYGAGIAGNIFALVLFISPLPTFKRIVRNGSTEQFSAM
PYIYSLLNCLICLWYGLPFVSYGVVLVATVNSIGALFQLAYTATFIAFADAKNRVKVSSL
LVMVFGVFALIVYVSLALFDHQTRQLFVGYLSVASLIFMFASPLSIINLVIRTKSVEYMP
FYLSLSMFLMSVSFFAYGVLLHDFFIYIPNGIGTVLGVIQLVLYGYFRKGSREDSLPLLV
THT

>Os01g50460 (SEQ ID NO: 80)
MDSLYDISCFAAGLAGNIFALALFLSPVTTFKRILKAKSTERFDGLPYLFSLLNCLICLW
YGLPWVADGRLLVATVNGIGAVFQLAYICLFIFYADSRKTRMKIIGLLVLVVCGFALVSH
ASVFFFDQPLRQQFVGAVSMASLISMFASPLAVMGVVIRSESVEFMPFYLSLSTFLMSAS
FALYGLLLRDFFIYFPNGLGLILGAMQLALYAYYSRKWRGQDSSAPLLLA

>Os01g65880 (SEQ ID NO: 79)
MEHIARFFFGVSGNVIALFLFLSPVVTFWRIIKKRSTEDFSGVPYNMTLLNCLLSAWYGL
PFVSPNNILVTTINGTGSVIEAIYVVIFLIFAERKARLKMMGLLGLVTSIFTMVVLVSLL
ALHGQGRKLFCGLAATIFSICMYASPLSIMRLVIKTKSVEFMPFLLSLSVFLCGTSWFIY
GLLGRDPFIAIPNGCGSFLGLMQLILYAIYRNHKGATPAAAAGKGDAADEVEDAKKAAAA
VEMADAKTNKVVADDADADGKSADDKVASQV

>Os05g35140 (SEQ ID NO: 76)
MEDLAKFLFGVSGNVIALFLFLSPVPTFWRIIRRKSTEDFSGVPYNMTLINCLLSAWYGL
PFVSPNNILVSTINGAGAVIETAYVVVFLVFASTHKTRLRTLGLAAAVASVFAAVALVSL
LALHGQHRKLLCGVAATVCSICMYASPLSIMRLVIKTKSVEYMPFLMSLAVFLCGTSWFI
YGLLGRDPFVTIPNGCGSFLGAVQLVLYAIYRNNKGAGGSGGKQAGDDDVEMAEGRNNK
VADGGAADDDSTAGGKAGTEV

Figure 44, Continued

>AT1G21460 (SEQ ID NO: 15)
MNIAHTIFGVFGNATALFLFLAPSITFKRIIKNKSTEQFSGIPYPMTLLNCLLSAWYGLP
FVSKDNTLVSTINGTGAVIETVYVLIFLFYAPKKEKIKIFGIFSCVLAVFATVALVSLFA
LQGNGRKLFCGLAATVFSIIMYASPLSIMRLVVKTKSVEFMPFFLSLFVFLCGTSWFVYG
LIGRDPFVAIPNGFGCALGTLQLILYFIYCGNKGEKSADAQKDEKSVEMKDDEKKQNVVN
GKQDLQV

>Mt3g124570 (SEQ ID NO: 143)
MSNTLRLAVAVLGNAASVSLYAAPMVTFKRVIRKKSTEEFSCIPYIIGLLNCLLFTWYGL
PIVSYKWENFPLVTVNGVGIALELSYVLIYFWYSSPKGKVKVAMITTPVLLVFCITVAVS
TFFLHDTTHRKLLVGSIGLVVSVALYGSPLVAMKKVIQTKSVEFMPLPLSLCAFSASVFW
LAYGILVRDVFVAGPSLVGTPLSILQLVIYFKYRKERVMEESKIGDLEKGSIELEKVVKV
EKIVTNCEQC

>Mt3g124590 (SEQ ID NO: 144)
MSETLRLAVAVLGNAASVSLYAAPMVTFKRVIRKKSTEEFSCIPYIIGLLNCLLFTWYGL
PIVSYKWENFPLVTVNGVGIALELSYVLIYFWYSSPKGKVKVAMIMTPVLLVFCIVAAVS
AFSFHDTAHRKLLVGSIGLGVSVALYGSPLVAMKKVIETKSVEFMPLPLSLCAFSASACW
LVYGILVRDVFVAGPSVVGTPLSILQLVVYFKYRKARVEEQKIGDLEKGSIELEKVVKV
EKIVTNCEQC

>MtC11004_GC (SEQ ID NO: 27)
MAETLRLAVAVIGNVASVSLYAAPIVTFKRVIRKKSTEEFSCIPYTIGLLNCLLFTWYGL
PIVSNKWENFPLVTVNGVGIVLELAYVLIYFWYSSSKGKVKVAMIAIPILLVFCAIALAS
AFAFPDHSHRKQLVGSVGLGVSIAMYASPLVVMKKVIQTKSVEFMPLPSLCSFLASVLW
LTYGLLIRDIFVAGPSVIGTPLGILQLVLHCKYWKRKVVIEEPNKVDLPKLVSLENLDLE
KGGLEKGNLEKNVTTS

>AT5G53190 (SEQ ID NO: 20)
MGDKLRLSIGILGNGASLLLYTAPIVTFSRVFKKKSTEEFSCFPYVMTLFNCLIYTWYGL
PIVSHLWENLPLVTINGVGILLESIFIFYFYASPKEKIKVGVTFVPVIVGFGLTTAIS
ALVFDDHRHRKSFVGSVGLVASISMYGSPLVASISMYGSPLVVMKKVIETRSVEYMPFYLSFFSFLASSLW
LAYGLLSHDLFLASPNMVATPLGILQLILYFKYKNKKDLAPTTMVITKRNDHDDKNKATL
EFVVDVDRNSDTNEKNSNNASSI

Figure 44, Continued

>Os01g12130.1 (SEQ ID NO: 84)
MVSNTIRVAVGILGNAASMLLYAAPILTFRRVIKKGSVEEFSCVPYILALFNCLLYTWYG
LPVVSSGWENSTVSSINGLGILLEIAFISIYTWFAPRERKKFVLRMVLPVLAFFALTAIF
SSFLFHTHGLRKVFVGSIGLVASISMYSSPMVAAKQVITTKSVEFMPFYLSLFSFLSSAL
WMIYGLLGKDLFIASPNFIGCPMGILQLVLYCIYRKSHKEAEKLHDIDQENGLKVVTTHE
KITGREPEAQRD

>Os05g12320 (SEQ ID NO: 86)
MFPDIRFIVGIIGSVACMLLYSAPILTFKRVIKKASVEEFSCIPYILALFSCLTYSWYGF
PVVSYGWENMTVCSISSLGVLFEGTFISIYVWFAPRGKKKQVMLMASLILAVFCMTVFFS
SFSIHNHHIRKVFVGSVGLVSSISMYGSPLVAMKQVIRTKSVEFMPFYLSLFTLFTSLTW
MAYGVIGRDPFIATPNCIGSIMGILQLVVYCIYSKCKEAPKVLHDIEQANVVKIPTSHVD
TKGHNP

>AT4G15920 (SEQ ID NO: 1)
MAEASFYIGVIGNVISVLVFLSPVETFWKIVKRRSTEEYKSLPYICTLLGSSLWTYYGIV
TPGEYLVSTVNGFGALVETIYVSLFLFYAPRHLKLKTVDVDAMLNVFFPIAAIVATRSAF
EDEKMRSQSIGFISAGLNIIMYGSPLSAMKTVVTTKSVKYMPFWLSFFLFLNGAIWAVYA
LLQHDVFLLVPNGVGFVFGTMQLILYGIYRNAKPVGLSNGLSEIAQDEEEGLTSRVEPLL
S

>AT3G16690 (SEQ ID NO: 2)
MADLSFYVGVIGNVISVLVFLSPVETFWRIVQRRSTEEYECFPYICTLMSSSLWTYYGIV
TPGEYLVSTVNGFGALAESIYVLIFLFFVPKSRFLKTVVVLALNVCFPVIAIAGTRTLF
GDANSRSSSMGFICATLNIIMYGSPLSAIKTVVTTRSVQFMPFWLSFFLFLNGAIWGVYA
LLLHDMFLLVPNGMGFFLGIMQLLIYAYYRNAEPIVEDEEGLIPNQPLLA

>MtD03138_GC (SEQ ID NO: 30)
MFLSPVPTFWRIIKKKSTEEFSSFPYICTLLNSSLWTYYGTIKAGEYLVATVNGFGIVVE
TIYILLFLIYAPPKMRVKTAILAGILDVLILAAAVVTTQLALEGEARSGAVGIMGAALNI
LMYGSPLAVMKTVVKTKSVEYLPFLLSFFFLNGGWLLYAVLVRDSILGVPNGTGFVLG
AIQLVLHGIYRNGKQSKHVSNKLEEGWQHEHLISSSTTRSHDRENLPI

Figure 44, Continued

>PpSWEe (SEQ ID NO: 145)
GNITAICLFTSPIPTFIKIVKKKTVADYSGFPYVCTLLNCLLWVVYGLPVVEFQVLVVTI
NAAGCFIEFLFLTLYLLNAEKKIRMKVMKLLMLVLVSFIAVTVLVLELIEDKKKRKTVIG
TLCAVFAVGMYASPLSIMRMVIQTRSVKYMPFLLSLFNFINGLVWFGYAFIGGVDIYIAI
PNGLGAASGIAQLALYAFYRNATPRDGDEKGNPTKATNNNFASIELEKNGAQKQSSHVSK
SQTNEIVX

>PpSWEc (SEQ ID NO: 146)
MFCPVCCWSGNITAICLFTSPVPTFSKIVKKKTVAEFSGIPYVCTLLNCLLWVVYGLPIV
EFQVLVISINAAGCLIEFTYLALYLTYAQKSIRMKVMKVLMAVLITFIAVTILVLELVHD
KKKRKLIIGTLCAVFAVGMYVSPLTVMKMVIQTRSVKYMPFLLSLFNFINGLVWFGYAFF
GGIDIFIAIPNGLGALSGIAQLALYAFYRNATPRDEDEKDGPTKPTNNSIEMEKNDTYKQ
SNVX

>PpSWEd (SEQ ID NO: 147)
MGHVDFKVILGVLGNITAICLFASPIPTFINIVKKKSVGDYSGIPYVCTLLNCLLWVVYG
LPVVEYQVLVVTINAAGCIIELIYLALYLKNAHKSIRMKVMKVLLAVLILFTLVTIVILE
LIHDKKKRKLVIGTLCAVFAVGMYVSPLTVMRMVIRTRSVEYMPFLLSLFNFINGLVWFG
YAFIGGLDIFIAIPNGLGALSGVAQLSLYAFYRNATPVVRDRDDVEKAKHMKPNTDSVYV
QMGQNGHPPQSEANGAHX

>PpSWEb (SEQ ID NO: 148)
MLSVRVSCNFYSPTFVDIVKRKSVGDYSGIPYICTLLNCLLWVVYGLPVVELQVLVVTIN
AAGVVIEMIYIGLYLKNAQRSVRVKVMKVLLAVLILFTAIAVLVFVLIHDRKTRKLLVGT
LCAVFGVGMYISPLAVMRLVIWTRSVEYMPFLLSLFNFINGLVWFGYAVIGHLDIFIAIP
NCLGALSGVAQLSLYAYFRPATPTVRDRNEEKGNSMKWVSSSVSILVEQNDHPPLNQPCG
SIEALQICEKASNX

>PpSWEa (SEQ ID NO: 149)
MRVAGNITASFLFLSPVPTFWRIVKSRKVDDFSGMPYLTAALNTCLWTLYGLPFVSFQVL
VVTVNAAGAGLEISYIIIYLMYSEGKARMRVVKFFAVMVCGFILMTGLVLGLVDSVDTRK
TILGVMGAFLGSLMYAAPLTVMRMVIQTKSVEFMPFLLSLFVFLNSTTWTIYAGVPETDL
YILIPNGLGLLLGTTQLVLYAMYRGSTPRKPSLPTFSYKLAVETPPKFAPAPDSKANRPL
GPGNQKAPENVX

Figure 44, Continued

>AT5G62850_AtVEX1 (SEQ ID NO: 16)
MTDPHTARTIVGIVGNVISFGLFCAPIPTMVKIWKMKSVSEFKPDPYVATVLNCMMWTFY
GLPFVQPDSLLVITNGTGLFMELVYTIFFVFATSPVRRKITIAMVIEVIFMAVVIFCT
MYFLHTTKQRSMLIGILCIVFNVIMYAAPLTVMKLVIKTKSVKYMPFFLSLANFMNGVVW
VIYACLKFDPYILIPNGLGSLSGIIQLIYITYYKTTNWNDDDEDKEKRYSNAGIELGQA

>AT3G28007 (SEQ ID NO: 18)
MVNATVARNIAGICGNVISLFLFLSPIPTFITIYKKKVEEYKADPYLATVLNCALWVFY
GLPMVQPDSLLVITNGTGLAIELVYLAIFFFFSPTSRKVKVGLWLIGEMVFVGIVATCT
LLLFHTHNQRSSFVGIFCVIFVSLMYIAPLTIMSKVIKTKSVKYMPFSLSLANFLNGVVW
VIYALIKFDLFILIGNGLGTVSGAVQLILYACYKTTPKDDEDEEENLSKVNSQLQLS
GNSGQAKRVSA

>Os01g42090.1 (SEQ ID NO: 70)
MISPDAARNVVGIIGNVISFGLFLSPVPTFWRICKRKDVEQFKADPYLATLLNCMLWVFY
GIPIVHPNSILVVTINGIGLIVEGTYLFIFFLYSPNKKRLRMLAVLGVELVFMLAVILGV
LLSAHTHKKRSMIVGILCVFFGSIMYFSPLTIMGKVIKTKSVEYMPFFLSLVCFLNGVCW
TAYALIRFDIYVTIPNGLGAIFGAIQLILYACYRTTPKKTKAAKDVEMPSVVSGPGAAA
TASGGSVVSVTVER

>Os01g42110.1 (SEQ ID NO: 72)
MISPDAARNVVGIIGNVISFGLFLAPVPTFWRICKRKDVEEFKADPYLATLLNCMLWVFY
GIPVVHPNSILVVTINGIGLLVEGTYLLIFFLYSPNKKRLRMCAVLGVELVFMLAVILGV
LLGAHTHEKRSMIVGILCVFFGSIMYFSPLTIMGKVIKTKSVEYMPFFLSLVCFLNGVCW
TAYALIRFDIYVTIPNGLGALFGAIQLILYACYRTTPKKTKAAKDVEMPSVVVSGTGAA
AAAGGGNTGGGSVSVTVER

>man_Os09g08270 (SEQ ID NO: 66)
MVSPDLIRNVVGIVGNAISFGLFLSPVLTFWRIIKEKDMKYFKADPYLATLLNCMLWVFY
GLPIVHPNSILVVTINGIGLVIEAVYLTIFFLFSNKKNKKMGVVLATEALFMAAVALGVL
LGAHTHQRRSLIVGILCVIFGTIMYSSPLTIMSQVVKTKSVEYMPLLLSVVSFLNGLCWT
SYALIRFDIFITIPNGLGVLFTLMQLILDKNQDKNLELPTVAPVAKETSIVTPVSKDDDI
NGSTASHVIINITKEP

Figure 44, Continued

>man_Os09g08440 (SEQ ID NO: 62)
MVSPDLIRNMVGIVGNIISFGLFLSPVPTFYRIIKNKDVQDFKADPYLATLLNCMLWVFY
GLPIVHPNSILVVTINGIGLVIEAVYLTIFFLFSDKKNKKMGVVLATEALFMAAVLGV
LLGAHTHQRRSLIVGILCVIFGTIMYSSPLTIMSQVVKTKSVEYMPLLLSVVSFLNGLCW
TSYALIRLDIFITIPNGLGVLFALMQLILYAIYYRTIPKKQDKNLELPTVAPVAKDTSIV
TPVSKDDDVDGGNASHVTINITIEL >man_Os09g07860 (SEQ ID NO: 150)
MVSPDLIRNVVGIVGNVISFGLFLSPVPIFWRIIKNKNVQNFKADPYLATLLNCMLWVFY
VLPIVHPNSILVVTINGISLVIEAVYLTIFFLFSDKKNKKMGVVLATEALFMAAVAVGV
LLGAHTHQRRSLIVGILCVIFGTIMYSSPLTIMVVKTKSVEYMPLLLSVVSFLNGLCWTL
YALIRFDIFITIPNGLGVLFAIMQLILYAIYYRTTPKKQDKNLELPTVAPIAKDTSIVAP
VSNDDDVNGSTASHATINITIEP >man_Os09g08030 (SEQ ID NO: 68)
MVSPDMIRNVVGIVGNVISFGLFLSPVPTFWQIIKNKNVXDFKTDPYLATLLNCMLWDFY
GLPIVHPNSILVVTINGIGLVIEAVYLTIFFLFSDKKNKKMEVVLAAEALFMAAVALGV
LLGVHTHQRRSLIVGILCVIFDTIMYSSPLTMSQVVKTKSVEYMPLLLSVVSFLNGLYW
TSYTLIRFDIFITIPNGLGVLFAAVQLILVIYYRTTPKKQNKNLELPTVTPVAKDTSVG
PISKDNDLNGSTASHVTIDITIQP >man_Os09g08490 (SEQ ID NO: 64)
MVPDLIRNVVGIVGNVISFGLFLSPVPTFWRIIKNKDVRDFKADQYLATLLNCMLWVFYG
LPIVHPNSILVVTINGIGLVIEAVYLTIFFLFSDKKNKKMGVVLATEALFMAAVALGVL
LDAHTHQRRSLIVGILCVIFGTIMYSSPLTIMSQVVKTKSVEYMPLLLSVVSFLNGLCWT
SYALIRFDIFITIPNGLGVFALMQLILYAIYYRTTPKKPSTTGPHPRSRIRTSSYQPSP
PSPRAPASSPLSARTTTSMAAMSPSISRLSHKLA >Os05g51090 (SEQ ID NO: 58)
MVMNPDAVRNVVGIIGNLISFGLFLSPLPTFVTIVKKDVEEFVPDPYLATFLNCALWVF
YGLPFIHPNSILVVTINGTGLLIEIAYLAIYFAYAPKPKRCRMLGVLTVELVFLAAVAAG
VLLGAHTYDKRSLIVGTLCVFFGTLMYAAPLTIMKQVIATKSVEYMPFTLSLVSFINGIC
WTIYAFIRFDILITIPNGMGTLLGAAQLILYFCYDGSTAKNKGALELPKDGDSSAV

Figure 44, Continued

>Os02g19820 (SEQ ID NO: 74)
MVSPDTIRTAIGVVGNGTALVLFLSPVPTFIRIWKKGSVEQYSAVPYVATLLNCMMWVLY
GLPAVHPHSMLVITINGTGMAIELTYIALFLAFSLGAVRRRVLLLAAEVAFVAAVAALV
LNLAHTHERRSMIVGILCVLFGTGMYAAPLSVMKMVIQTKSVEYMPLFLSLASLVNGICW
TAYALIRFDLYITIPNGLGVMFAVAQLILYAIYYKSTQQIIEARKREADHVAMTDVVVD
SAKNNPSSGAAAAANGRY

>Mt3g109190 (SEQ ID NO: 151)
MSTAEIARTAVGIIGNVIAGCMFLSPVPTFVGICKKGSVEQYSPVPYLATLMNCMVWTLY
GLPMVHPHSFLVVTINGAGCVVEIIYITLFLIYSDRKKRLKVFLGLLLELIFLLSFVS
LTMLHTVNKRSAVVGTICMLFNIGMYASPLSIMKLVIKTKSVEFMPFFLSLASFGNGVSW
TIYALIPFDPFIAIPNGIGTMFAVVQLILYASYYKSTQEQIAARKNNGKGEMNLSEVVVG
MSNATVQDNKKITAIDHSSPSAK

>AT4G10850 (SEQ ID NO: 13)
MVFAHLNLLRKIVGIIGNFIALCLFLSPTPTFVRIVKKSVEEYSPIPYLATLINCLVWV
LYGLPTVHPDSTLVITINGTGILIEIVFLTIFFVYCGRQKQRLIISAVIAAETAFIAILA
VLVLTLQHTTEKRTMSVGIVCCVFNVMMYASPLSVMKMVIKTKSVEFMPFWLSVAGFLNA
GVWTIYALMPFDPFMAIPNGIGCLFGLAQLILYGAYYKSTKRIMAERENQPGYVGLSSAI
ARTGSEKTANTNQEPNNV

>AT1G66770 (SEQ ID NO: 14)
MVHEQLNLIRKIVGILGNFISLCLFLSPTPTFIHIVKKKSVEKYSPLPYLATLLNCLVRA
LYGLPMVHPDSTLLVTISGIGITIEIVFLTIFFVFCGRQQHRLVISAVLTVQVVFVATLA
VLVLTLEHTTDQRTISVGIVSCVFNAMMYASPLSVMKMVIKTKSLEFMPFLLSVVGFLNA
GVWTIYGFVPFDPFLAIPNGIGCVFGLVQLILYGTYYKSTKGIMEERKNRLGYVGEVGLS
NAIAQTEPENIPYLNKRVSGV

>AT5G40260 (SEQ ID NO: 11)
MVDAKQVRFIIGVIGNVISFGLFAAPAKTFWRIFKKKSVEEFSYVPYVATVMNCMLWVFY
GLPVVHKDSILVSTINGVGLVIELFYVGVYLMYCGHKKNHRRNILGFLALEVILVVAIL
ITLFALKGDFVKQTFVGVICDVFNIAMYGAPSLAIIKVVKTKSVEYMPFLLSLVCFVNAG
IWTTYSLIFKIDYYVLASNGIGTFLALSQLIVYFMYYKSTPKEKTVKPSEVEISATERV

Figure 44, Continued

>PpSWEf (SEQ ID NO: 152)
GNVFSFIMFFSPLPTFWTIIKRRETGQFSVVPYVATLLNCLMWLFYGTSSVAGLMLVLTI
NAAGVVIESIYIIHVLFGDFESRKRTGCYFLGIMVLYTIVLCCVTQAVEVNDRVTVVGA
ICVVIGSIMYSAPMTVIAQVIRDKNVANMPLFLSASSLINSVVWTTYGILVEDVFVIVSN
AFNVDTLNVFFX
>chExt-fgenesh2 (SEQ ID NO: 153)
MGASGNMLLLDTVVPGMGAVISILMYLSPLKAVLKAQREKHLGDLNPIPFSITIANCIAWL
GYGLLKKDPFVCAPNAPGVLIGTYMSLTAHGLADEGAKERIRFVVCLAAAIFPFLGVYTS
FFAPSAVVQQGVWGMAGNIVCLVYYAAPLSTMWDVIRTRNSSSILVPLTMMNTLNAALWT
TYGVAVADPYIWAPNGIGLALSVMQIALRLVFPARAASALPSHAHHSGGSGASKYARLDE
EVPLGGAGHX
>chExt-gwp_1W-C_30203 (SEQ ID NO: 154)
MTAWTGRRALLDDDEFDFKKLFLHHLAPGLGCIIAFLMFVSPLKTVLQIRANKHLGDLN
PLPLVAIIANCAAWLIYGCINADPYVITANEPGLLLGIFMTVSCYGFADPKARDVMLKAL
MFFAVLLSAVGIAIALFIEEDETASKTAGYTAVFILLCYYGAPLSTMAEVLRSRSSASLF
WPTSLMNTINGLLWVAYGTAVSDPFIAVPNAIGAAFGVIQIGLINIYPAKK
>chAU_G14250_T1 (SEQ ID NO: 155)
MGVFTEHVVPIFGNILACAMLVSPFPAVLRLRAAGKLGDINPLPYPMTVVNAAGWVAYGF
AVANPYIFFPANVVGFLAGVFFTFTAYAAAAPKQVQDRITGIMVAASAHYIMLGLIACFALS
HTAGARMWGTSAVVILMLYYFVPLSTMVQIVKTRNAASIYPPLAITAIANGLMWSIYGFA
IMDINLWLPNLFGSIVGVIQLLLRLLVYGAKPTAAAAGGGALAVGAGAVAADDEETAAFAK
TGAEPSGX
>CeR10D12_9 (SEQ ID NO: 156)
MFLEIFRVWIGFFSISFIFLPIYLVLDWKKRGTSDGFSAVVLIIPGIIQSFWLRHGWMTN
EWTHIIINTVNLTALSFYISAYAYYQSNRKNLIGQLISAVIIVKCAFFYVDSHDAEHTNS
AMGTVAAGAQILGLGGRVYEMRRAVKLGTTEYIPAFMQFAVSALMAQWLLFGIVTGNQFI
ANANVAGLTASAITLYFKYPPLTWTVPLFNIPPQNAKKE

Figure 44, Continued

>CeK11D12_5 (SEQ ID NO: 157)
MFLEIFTVWLGIFSIGFTFLPMFMVLDWHKRGTADGFSSVNFVLPMLVQSFWLRHGYMTN
DQTNIIINSINLVFFAFYVSAFAYYQPKRKYLIGQIVAAALAVKVAFAYVDTHDSASIND
AMGSMAAGAQIFSLVGGIYEIKRAISMGTTEYIPAGFQFAIFTLILQWLLFGILHGNQFI
AISNAAGLLVNIATLALYFFYPPLTWTVPIFNIPPQNKDAKKVE

>CeY39A1A_8 (SEQ ID NO: 158)
MTTSLGQTILPYLSFTALSSTVAFFLCGLQICHRIKTRGSSEGTSPAPFLLSFLSCGLFI
QYGLLKDDDVITYCNGIGCFLQACYLMYFYMTRNRRFLNKVISIELGIIGIVVYWVAHS
TNSHLTKTTYVGNYCIFLNICSVAAPLFDIGKVVRNKSSESLPLCVACFVVCLQWMFY
GYIVDDIVILVPNVIATVISILQLSLFIIYPGAPAGVLPQKYEHI

>CeK06A4_4 (SEQ ID NO: 159)
MEIDLGTVSASRLFAMYTSNLVWSLFLTSTALHAVALITSPVQAVHKWVWRRQSSDSDTPI
PYICAVIGSALWLRYSIFLRDTKLILLQTYAVSMQLFFVIALIFYRTKRRKLIRLMTGIA
AALSLLFLYIGNMNDEDGKEFTGRIASGAQIAGSLVCPYLIYKAVTSKCIDFVPLAPVVF
TWVMELHAIVYSIGIDDFYMLLANVIFFCMDGSLLSMFFVYPTEKKKNLKSSPIPTVM

SUGAR TRANSPORTERS

RELATED APPLICATIONS

The present application claims priority to U.S. Provisional Application No. 61/175,267 (filed May 4, 2009), which is hereby incorporated by reference in its entirety.

SEQUENCE LISTING SUBMISSION VIA EFS-WEB

A computer readable text file, entitled "056100-5077-SeqListing.txt," created on or about Oct. 20, 2010 with a file size of about 2,455 kb contains the sequence listing for this application and is hereby incorporated by reference in its entirety.

FIELD OF THE INVENTION

The present invention relates to novel sugar transporters across the membrane of a cell.

BACKGROUND OF THE INVENTION

The need and use of carbohydrates in many biochemical pathways has been extensively studied and reported over centuries. Mono-, di-, and polysaccharides, or sugars, are a prime dietary source of carbohydrate for many organisms.

Glucose is one of the more readily available sugars and its structure lends itself to be readily acted on by the biochemical systems of many organisms. Comprised of six carbon atoms, glucose falls within the category of aldehexoses. Aldehexose has four chiral centers which lead to 16 stereoisomers. Two stereoisomers of aldehexoses are regarded as glucoses, the major one being D-glucose. All major dietary carbohydrates contain glucose, either as their only building block, as in starch and glycogen, or together with another monosaccharide, as in sucrose and lactose. The metabolism of this carbohydrate translates into energy, such as adenosine triphosphate (ATP). Other metabolic routes for glucose lead to energy storage. The glucose molecule can exist as an open-chain (acyclic) form or in a ring (cyclic) form.

Glucose may be used as a precursor for the synthesis of several important substances, such as starch, cellulose, and glycogen. Lactose, a sugar in milk, is a glucose-galactose disaccharide. Sucrose, another disaccharide, joins glucose to fructose. While glucose is the major transport form of sugars in metazoa, sucrose and its derivatives serves as the major transport form in plants.

Glucose is one of the downstream products of photosynthesis in plants and some prokaryotes. In eukaryotes, such as animals and fungi, glucose may be produced as the result of the breakdown of glycogen, through a process referred to as glycogenolysis. In plants, the resulting breakdown substrate is starch. Glucose may also be derived from the action of invertase on the major transport sugar sucrose in plants (in the cell wall, the cytosol or vacuole, each by a specific isoform).

In animals, glucose may be synthesized in the liver and kidneys from non-carbohydrate intermediates, such as pyruvate and glycerol through a process referred to as gluconeogenesis. Glucose may also be synthesized, such as through enzymatic hydrolysis of starch. Commercially, crops such as maize, rice, wheat, potato, cassava, sago, and arrowroot may be used as a source of starch.

Glucose may be used in either aerobic or anaerobic respiration. Carbohydrates are a significant source of energy for organisms. Aerobic respiration can provide roughly 3.75 kcal of energy per gram. Breakdown of carbohydrates, such as starch, results in monosaccharides and disaccharides. Through the process of glycolysis and the reactions of the citric acid cycle (or Krebs cycle), glucose is oxidized and broken down to eventually forms carbon dioxide and water, yielding energy sources, predominantly ATP. The insulin reaction, as well as other mechanisms, may regulate the concentration of glucose in the blood.

The need for energy in neurological centers, such as the brain, directly correlates glucose to psychological processes. Glucose is a primary source of energy for the brain, and hence its availability influences psychological processes. When glucose is low, psychological processes requiring mental effort may be impaired. Both aerobic and anaerobic respiration start with the early steps of the glycolysis metabolic pathway, the first step being the phosphorylation of glucose by hexokinase to prepare it for later breakdown to provide energy. The immediate phosphorylation of glucose by a hexokinase may then prevent diffusion out of the cell. The act of phosphorylation adds a charged phosphate group, thereby preventing the glucose-6-phosphate from easily crossing the cell membrane. Glucose is also important for the production of proteins and in the process of lipid metabolism. Glucose may also serve as a precursor molecule for ascorbic acid, or vitamin C.

Accordingly, the uptake, absorption, processing, metabolism, exchange and transport of sugars, such as glucose and sucrose, within a cell and between cells of a tissue in an organism is of utmost importance for the ability of a cell or the organism comprising the cell to thrive. Dysfunction of glucose or sucrose transport across cell membranes and between the organelles of a cell can be catastrophic. There is a need to develop methods to regulate the transport of glucose efficiently.

SUMMARY OF THE INVENTION

The present invention provides a novel class of protein transporters for transporting sugars in a cell. The transporters, referred to as GLUEs (also known as Glüs or SWEETs), may be in a plant and may be encoded by a nucleic acid encoding a sugar transporter (e.g. pentose, glucose, mannose, in sum monosaccharides), or sucrose and maltose (in sum di- and oligosaccharides) having at least 30%, 40%, 50%, 60%, 70%, 80%, 85%, 90%, 95%, or 99% sequence identity with the following accession nos: AT4G15920 (SEQ ID NO: 1), AT3G16690 (SEQ ID NO: 2), AT5G13170 (SEQ ID NO: 3), AtSAG29 (SEQ ID NO: 4), AT4G25010 (SEQ ID NO: 5), AT5G50800 (SEQ ID NO: 6), AT5G23660 (SEQ ID NO: 7), AT3G48740 (SEQ ID NO: 8), AT5G50790 (SEQ ID NO: 9), AT2G39060 (SEQ ID NO: 10), AT5G40260 (SEQ ID NO: 11), AtRPG1 (SEQ ID NO: 12), AT4G10850 (SEQ ID NO: 13), AT1G66770 (SEQ ID NO: 14), AT1G21460 (SEQ ID NO: 15), AT5G62850 (SEQ ID NO: 16), AtVEX1 (SEQ ID NO: 17), AT3G28007 (SEQ ID NO: 18), AT3G14770 (SEQ ID NO: 19), AT1G21460 (SEQ ID NO: 15), AT5G53190 (SEQ ID NO: 20), NEC1 (SEQ ID NO: 21 and SEQ ID NO: 21), AC202585 (SEQ ID NO: 22), AC147714 (SEQ ID NO: 23), MtC60432 GC (SEQ ID NO: 25 and SEQ ID NO: 26), MtC11004 GC (SEQ ID NO: 27 and SEQ ID NO: 28), CT963079 (SEQ ID NO: 29), MtD03138 GC (SEQ ID NO: 30), TC 125536 (SEQ ID NO: 31 and SEQ ID NO: 32), AC146866 (SEQ ID NO: 33), AC189276 (SEQ ID NO: 34), CAA69976 (SEQ ID NO: 35), AC2456 (SEQ ID NO: 36), TC115479 (SEQ ID NO: 37), AC146747 (SEQ ID NO: 38), MtC10424 GC (SEQ ID NO:

39), CT954252 (SEQ ID NO: 40 and SEQ ID NO: 41), CU302340 (SEQ ID NO: 42 AC202585 (SEQ ID NO: 43), AC147714 (SEQ ID NO: 44), MtC60432 GC (SEQ ID NO: 45 and SEQ ID NO: 46), MtC11004 GC (SEQ ID NO: 47 and SEQ ID NO: 48), CT963079 (SEQ ID NO: 49), Os08g42350 (Os8N3) (SEQ ID NO: 50 and SEQ ID NO: 51), Os08g0535200 (SEQ ID NO: 52 and SEQ ID NO: 53), Os12g29220 (SEQ ID NO: 54 and SEQ ID NO: 55), Os03g0347500 (SEQ ID NO: 56 and SEQ ID NO: 57), Os05g51090 (SEQ ID NO: 58 and SEQ ID NO: 59), Os05g0588500 (SEQ ID NO: 58 and SEQ ID NO: 59), Os12g07860 (SEQ ID NO: 60 and SEQ ID NO: 61), Os09g08440 (SEQ ID NO: 62 and SEQ ID NO: 63), Os09g08490 (SEQ ID NO: 64 and SEQ ID NO: 65), Os09g08270 (SEQ ID NO: 66 and SEQ ID NO: 67), Os09g08030 (SEQ ID NO: 68 and SEQ ID NO: 69), Os09g0254600 (SEQ ID NO: 68 and SEQ ID NO: 69), Os01g42090.1 (SEQ ID NO: 70 and SEQ ID NO: 71), Os01g0605700 (SEQ ID NO: 70 and SEQ ID NO: 71), Os01g42110.1 (SEQ ID NO: 72 and SEQ ID NO: 73), Os01g060600 (SEQ ID NO: 72 and SEQ ID NO: 73), Os02g19820 (SEQ ID NO: 74 and SEQ ID NO: 75), Os02g0301100 (SEQ ID NO: 74 and SEQ ID NO: 75), Os05g35140 (SEQ ID NO: 76 and SEQ ID NO: 77), Os05g0426000 (SEQ ID NO: 76 and SEQ ID NO: 77), Os01g65880 (SEQ ID NO: 78 and SEQ ID NO: 79), Os01g0881300 (SEQ ID NO: 78 and SEQ ID NO: 79), Os01g50460 (SEQ ID NO: 80 and SEQ ID NO: 81), Os01g0700100 (SEQ ID NO: 80 and SEQ ID NO: 81), Os01g36070.1 (SEQ ID NO: 82 and SEQ ID NO: 83), Os01g0541800 (SEQ ID NO: 82 and SEQ ID NO: 83), Os01g12130.1 (SEQ ID NO: 84 and SEQ ID NO: 85), Os05g12320 (SEQ ID NO: 86 and SEQ ID NO: 87), Os05g0214300 (SEQ ID NO: 88 and SEQ ID NO: 89), and Os01g21230 (SEQ ID NO: 88 and SEQ ID NO: 89) (all of which are herein incorporated by reference in their entirety). The nucleic acid may be in a vector and/or in a cell, such as a plant cell or an animal cell. The present invention also provides transgenic plants comprising the GLUEs. The nucleic acid may be encoded by a nucleic acid encoding a glucose or sucrose transporter having at least 30%, 40%, 50%, 60%, 70%, 80%, 85%, 90%, 95%, or 99% sequence identity with the following animal accession nos: (e.g. from the worm *C. elegans*) R10D12.9, K11D12.5, and K06A4.4, K02D7.5, C54F6.4, C06G8.1, Y39A1A.8, ci-rga, RAG1AP1 (e.g., from *Drosphila*, human, mouse, *Rattus norvegicus*, and *Xenopus*) (all of which are herein incorporated by reference in their entirety).

The present invention further provides mutated GLUE proteins. A GLUE may be mutated so that the passage of sugar through the GLUE is improved as compared to a wild type. The mutations may improve the functioning of a GLUE so that more sugar can be transported, either through increased rate of passage or through an increased capacity for transport. The mutation may prevent or impede the passage of sugar through the GLUE as compared to the wild type. The mutation may be a deletion or substitution of an amino acid or amino acids in the wild type sequence. The mutation may be a truncation of the GLUE.

The present invention provides fusion proteins comprising a GLUE protein. The GLUE may be fused to a tag, such as an epitope. The GLUE may be part of a chimeric membrane protein, such as other seven transmembrane protein with known downstream cascades. The chimeric protein may comprise replacing the third intracellular loop and/or the cytoplasmic tail of the GLUE with the corresponding domains from another seven transmembrane protein. The GLUE may be coupled to a targeting sequence to direct expression and location of the GLUE to a particular organelle or region within a cell. The GLUE may be a mutated GLUE protein.

The present invention provides methods of generating a plant that produces an increased level of carbon as compared to a control plant comprising introducing a nucleic acid encoding a mono-, di- or oligosaccharide transporter into a plant cell and growing the plant cell into a plant that expresses the nucleic acid, wherein the nucleic acid encodes a GLUE.

The present invention provides methods of increasing transport of sugar into the root of a plant comprising introducing into a cell of the plant a nucleic acid encoding a GLUE. The introduction of a GLUE into a plant may provide methods for modulating sugar secretion into the rhizosphere of a plant and methods for modulating transport of sugar into the phyllosphere of a plant or the delivery of sugars to developing seeds, flowers etc.

The present invention provides methods for altering the levels of sugar in a plant comprising introducing a nucleic acid encoding a GLUE into a cell. The methods may increase sugar levels within a cell. The methods may decrease sugar levels within a cell. The methods may direct sugar concentration to accumulate in certain regions, organs or organelles in a plant or animal. The methods may cause a decline in sugar levels in certain regions, organs, or organelles in a plant or animal. The methods may increase sugar import. The methods may decrease sugar import. The methods may increase sugar export. The methods may decrease sugar export. The GLUEs may be expressed in a cell with a cofactor, such as another intracellular protein or another transporter, such as a cotransporter.

The present invention provides methods of attracting beneficial microorganisms to a plant comprising altering the sugar concentration through the introduction of a GLUE. The present invention further provides methods of protecting a plant from a pathogen through the introduction of a GLUE. Pathogens attacking a plant may utilize the plant's cell machinery to alter sugar exportation in the plant. By introducing into the plant an exogenous GLUE, which may further be under the control of a different promoter, the pathogen's ability to alter sugar exportation may be limited or altered.

The present invention also provides methods for determining how a GLUE is acting within a cell or an organism. An exogenous GLUE may be co-expressed in a cell with a sugar detecting molecule, such as a protein comprising a sugar (e.g. glucose or sucrose) binding domain sandwiched between a fluorescent donor domain and a fluorescent acceptor domain. The concentration of sugar may be determined and monitored over time through the use of fluorescent resonance energy transfer.

The present invention provides methods for affecting and/or altering the expression of glucose transporter facilitator ("GLUT") proteins in a cell.

The present invention provides for methods of altering the sugar level within a fluid secreted by a cell, such as nectar or milk. The present invention provides methods for altering the development of an organism by introducing a GLUE into a cell in the organism. The GLUE may be mutated. The present invention provides methods for altering the development of an organism by mutating a GLUE in a cell in the organism. The increased or decreased functioning of a GLUE within an organism may alter sugar concentrations and/or sugar distribution through the cell and throughout the organism and thereby affect development.

BRIEF DESCRIPTION OF THE DRAWINGS

FIG. 1A shows a phylogenetic tree of the GLUE superfamily. Distances were calculated from a multiple sequence alignment (ClustalW) using the neighbor-joining method and the tree displays the bootstrap values (percentage of 1000). The SWEET family can be divided into 4 clades. All sequences were obtained from NCBI or the Aramemnon database. The trees for rice, arabidopsis, medicago, and petunia are illustrated. The scale shown represents a change of 50 bases per length illustrated.

FIG. 3A shows the response of the sensor to various concentrations of glucose without the co-expression of a GLUE. FIG. 3B shows that introducing GLUE1 into a cell with the glucose FRET sensor results in significant changes to the sensor when the concentration of sugar is altered.

FIG. 4A shows the response with GLUE1. FIG. 4B shows the response with GLUE12. FIG. 4C shows the response with GLUE8. FIG. 4D shows the response with GLUE13.

FIG. 9A shows the identification of glucose transport activity for SWEET1 by coexpression with the cytosolic FRET glucose sensor FLIPglu600μΔ13V in HEK293T cells. Individual cells were analyzed by quantitative ratio imaging of CFP and Venus emission (acquisition intervals 5 sec; Fc/D corresponds to the normalized emission intensity ratio). HEK293T/FLIPglu600μΔ13V cells were perfused with medium, followed by square pulses of increasing glucose concentrations. Cells expressing only the sensor did not accumulate significant amounts of glucose in the cytosol as indicated by a lack of a FRET ratio change (orange line). Cells coexpressing the sensor and SWEET1 accumulated glucose as evidenced by the negative FRET ratio change with an amplitude that correlates with the increasing external glucose supply (blue line). Data points are mean±SD (n>10). FIG. 9B shows FRET imaging of 'efflux' of glucose from the cytosol into the ER (cf. FIG. 9C). The sensor FLIPglu600μΔ13V$^{ER}$ was targeted to the lumen of the ER (analysis performed as under FIG. 9A, acquisition intervals 10 sec). Cells expressing only the sensor did not accumulate significant amounts of glucose in the ER. Cells coexpressing the sensor and SWEET1 accumulated glucose in the ER as evidenced by the negative ratio change induced by perfusion with glucose. Data points are mean±SD (n>10). FIG. 9C shows a cartoon for SWEET1 influx across the PM and efflux from cytosol to ER. The cytosolic sensor FLIPglu600μΔ13V identifies transport of glucose initiated at the extracellular face (indicated by extracellular N-terminus). FLIPglu600μΔ13V$^{ER}$ measures transport initiated at the intracellular side (cytosolic C-terminus). FIG. 9D shows a complementation of yeast strain EBY4000 lacking all 18 hexose transporter genes by SWEET1, SWEET8, or yeast HXT5; control: empty vector. FIG. 9E shows accumulation of glucose in EBY4000 coexpressing SWEET1 and FLII$^{12}$Pglu700ξδ6 before and after addition of 0, 20 and 100 mM glucose. Two cycles were run before addition of glucose. Data are mean±SD, n=3. FIG. 9F shows kinetics of $^{14}$C-glucose accumulation by SWEET1 in EBY4000. Data are mean±SD, n=3. FIG. 9G shows confocal imaging of SWEET1-YFP in leaves of stably transformed Arabidopsis leaves. FIG. 9H shows structural model of SWEETs based on hydrophobicity plots. Each protein contains seven TMHs with a predicted extracellular N-terminus and a predicted parallel orientation of two 'subunits' derived from a duplication of three TMHs (TMH1-3 and 5-7, highlighted by red and blue triangles), separated by TMH4 as linker. FIG. 9I shows uptake of [$^{14}$C]-glucose into Xenopus oocytes mediated by SGLT1, but not by OsSWEET11. Coexpression of OsSWEET11 with SGLT1 reduces glucose accumulation in oocytes. Data are mean±SE, n=7. Inset indicates concentrative uptake of glucose by SGLT1 and glucose efflux ('leak') caused by OsSWEET11. FIG. 9J shows direct efflux measurements from oocytes expressing SWEET1 or OsSWEET11. 50 nl of 10 mM radiolabeled glucose (0.18 μCi/μl) were injected and radiotracer efflux was measured over time. Data are mean±SE (n>10 cells).

FIG. 10A shows induction of SWEET mRNAs by either the bacterium Pseudomonas syringae pv. tomato DC3000 ($2 \times 10^8$ cfu/ml, 8 hrs post inoculation, measured by qPCR, normalized by MgCl$_2$ buffer treatment), the powdery mildew fungus, G. cichoracearum, (~25-35 conidiospores mm$^{-2}$, 48 hrs post inoculation, measured by qPCR; normalized to 0 hr values), or by the fungus Botytis cinerea) in Arabidopsis leaves. FIG. 10B shows induction of SWEET4, 5 and 15 by P.s. DC3000 depends on a functional type III secretion system (T3S). Samples were collected at 6, 12 and 24 hr after infiltration with $2 \times 10^8$ cfu/ml of DC3000 or DC3000 ΔhrcU, a T3S mutant. FIG. 10C shows infection by G. cichoracearum leads to induction of SWEET11 and SWEET12 but downregulation of SWEET15. Samples were taken after 0, 8, 12, 24 and 72 hr post-inoculation.

FIG. 11A shows the pathogenic bacterium Xanthomonas oryzae pv. oryzae strain PXO99$^A$ (X.o. PXO99$^A$) injects the TAL effector PthXo1 via type III secretion system into rice cells. This transcriptional activator directly or indirectly triggers induction of the rice OsSWEET11/Os8N3 glucose efflux transporter gene leading to secretion of glucose. Bacteria take up glucose via endogenous uptake systems and can multiply. FIG. 11B shows that if PthXo1 is mutated (ME), induction of OsSWEET11/Os8N3 is reduced or abolished, leading to starvation of the bacteria (indicated as reduced size of bacterial cell, meant low cell number). FIG. 11C shows mutation of OsSWEET11/Os8N3 also leads to starvation of bacteria. FIG. 11D shows a pathogen expressing an alternative effector AvrXa7 can multiply if it induces another member of the SWEET family (or by inducing access to another carbon source).

FIG. 12A shows inhibition of GLUT1 activity by 20 μM cytochalasin B analyzed using the FLIPglu600μΔ13V sensor co-transfected with GLUT1. FIG. 12B shows insensitivity of SWEET1 activity to 20 μM cytochalasin B analyzed using the FLIPglu600μΔ13V sensor co-transfected with SWEET1. FIG. 12C shows expression level of SLC2 (GLUT) and SLC5 (SGLT) glucose transporter genes in HepG2 cells, HEK293T cells, and HEK293T cells coexpressing FLIPglu600μΔ13V and/not SWEET1.

FIG. 13A shows pH optimum for SWEET1. Radiotracer uptake was measured at different pH. The pH optimum for uptake is about pH 8.5. Data are mean±S.D. FIG. 13B shows inhibition of glucose uptake (5 mM D-glucose; 0.1 μCi [$^{14}$C]-D-glucose) mediated by SWEET1 in the yeast strain EBY4000 by different sugars. Competitors were added at 10-fold excess (final concentration 50 mM). Relative activity was normalized to D-glucose uptake rate [100%]. Data are mean±S.D.

FIG. 15A shows cells coexpressing the cytosolic FRET glucose sensor FLIPglu600μΔ13V and SWEET8 accumulated glucose in the cytosol as evidenced by a negative cytosolic FRET ratio change in HEK293T cells (cf. FIG. 9A). FIG. 15B shows cells 'efflux' glucose from the cytosol into the ER when coexpressing the ER FRET glucose sensor FLIPglu-600μΔ13V$^{ER}$ and SWEET8 in HEK293T cells (cf. FIG. 9B). Data points are mean±SD (n>10). FIG. 15C shows relative uptake rate of SWEET1, SWEET8 and vector control in the yeast glucose transport-deficient mutant EBY4000 (2 min; 10 mM D-glucose; 0.1 μCi [$^{14}$C]-D-glucose). Values are normalized to SWEET1 (100%). Data are mean±S.D. FIG. 15D shows confocal imaging of SWEET8 localization in seedlings using stably transformed *Arabidopsis* (T1 generation).

FIG. 19A shows uptake of [14C]-glucose into *Xenopus* oocytes mediated by SGLT1, GLUE1, but not by OsGLUE11. Coexpression of OsGLUE11 with SGLT1 reduces glucose accumulation. FIG. 19B shows uptake of $^{14}$C-glucose into *Xenopus* oocytes mediated by CeSWEET1, 3, 4, 5, 7 and RAG1AP1 splice variants 1, and 2 and a mutated version (Y216A, L218A, L219A; RAG1AP1-3aa). SGLT1 served as control. FIG. 19C shows the effect of coexpression of CeSWEETs and RAG1AP1 variants on glucose accumulation by SGLT1 in *Xenopus* oocytes. All experiments were repeated independently at least 6 times. Error bars are means±SD.

FIG. 44 shows the amino acid sequence for various GLUE proteins in *C. elegans*, mouse, rat, human, *Arabidopsis*, rice, *Medicago*, and *petunia*.

DETAILED DESCRIPTION

Figure 1:
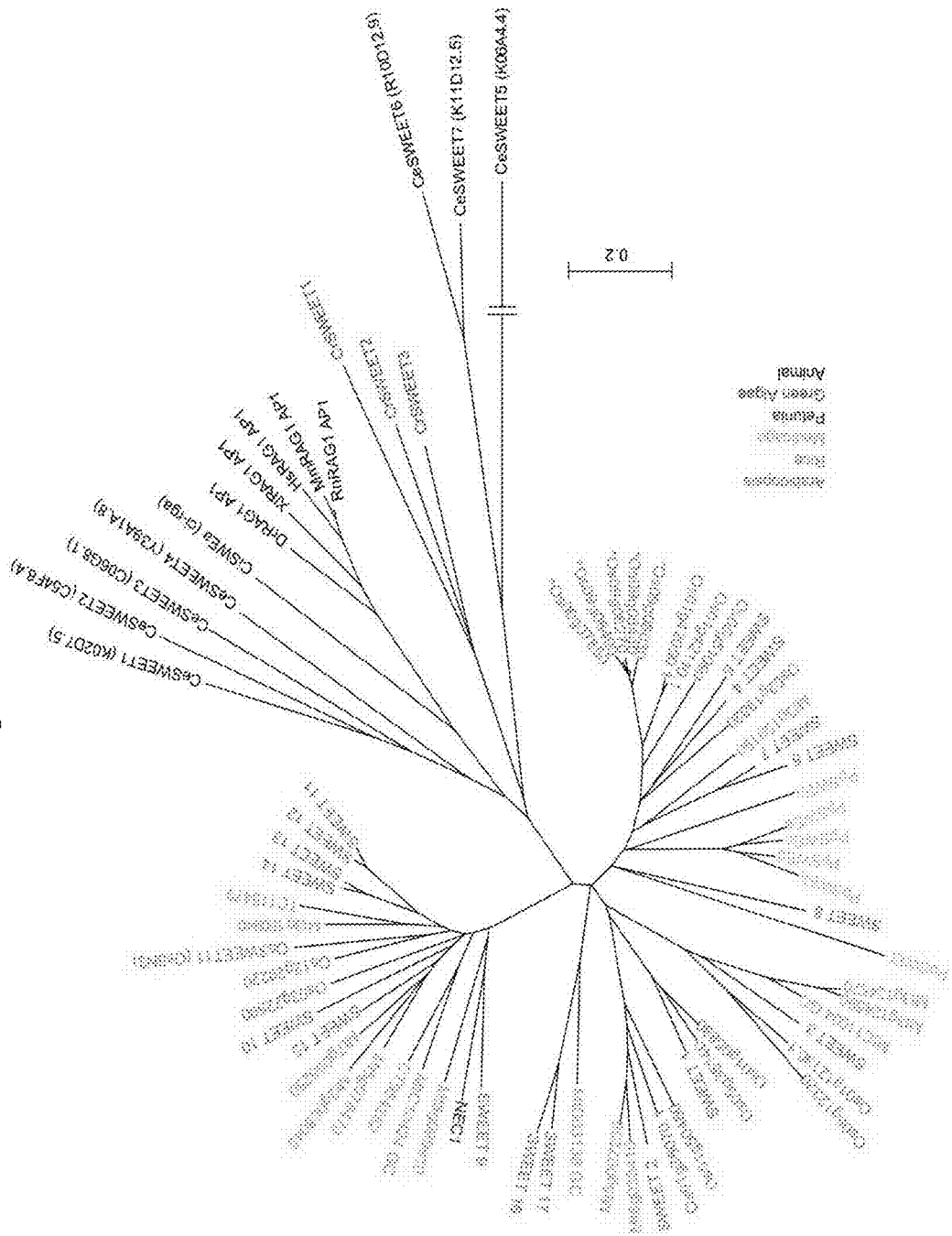
FIG. 1 shows a phylogenetic tree of the GLUE superfamily cDNA in various plant species.
Figure 2:
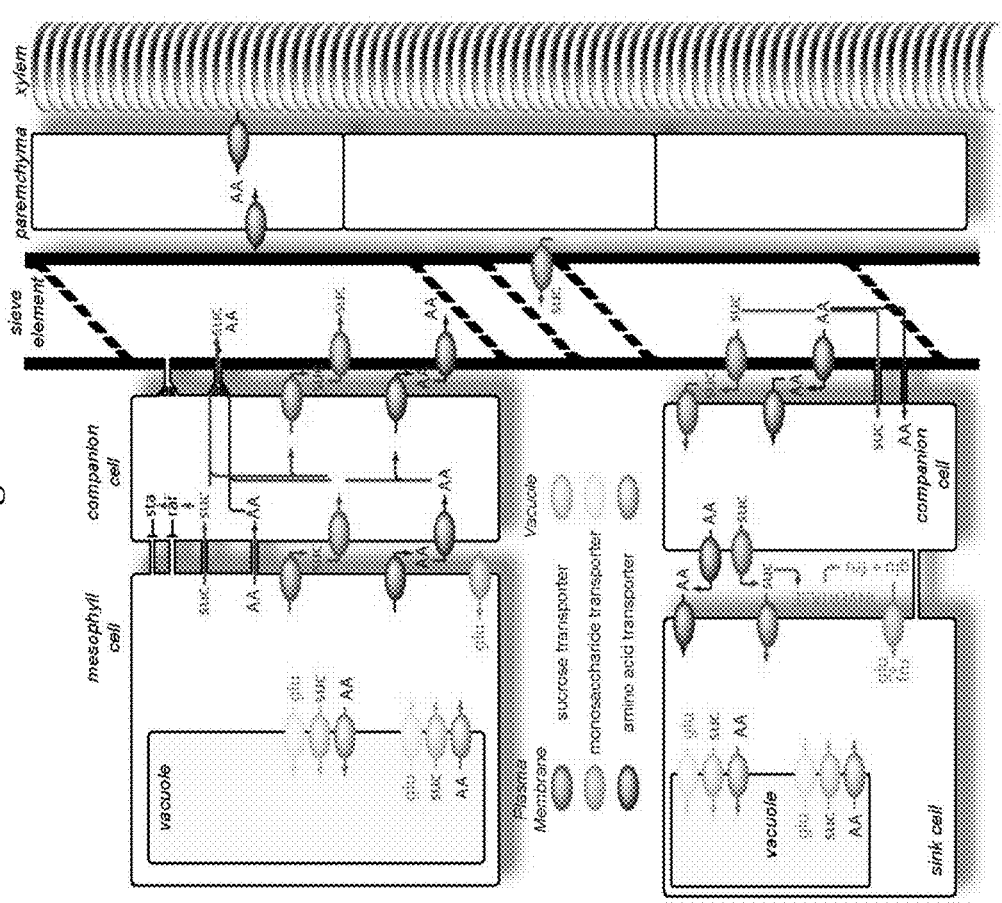
FIG. 2 shows an overview of various means by which sugars are transported and move within a cell and with the organs and organelles of a plant.

The following description includes information that may be useful in understanding the present invention. It is not an admission that any of the information provided herein is prior art or relevant to the presently claimed inventions, or that any publication specifically or implicitly referenced is prior art.

Other objects, advantages and features of the present invention may become apparent to one skilled in the art upon reviewing the specification and the drawings provided herein. Thus, further objects and advantages of the present invention will be clear from the description that follows.

Plants require sugar efflux transporters to support seed and pollen development, produce nectar and nurture beneficial microorganisms in the rhizosphere. The identity of these efflux transporters however has remained elusive. Using optical sugar sensors, a novel class of sugar transporters ("GLUE", "Glüs", or "SWEET") has been identified from plants. *Arabidopsis* and rice GLUEs functions as an im- and exporters of sugars. OsGluE11/Os8N3 and AtGluE8/RPG1 are required for pollen viability. Expression of GLUE homologs in nectaries and root nodules suggests roles in feeding pollinators and symbionts. Fungal and bacterial pathogens modulate mRNA levels of different GLUE members to co-opt mono-, di- or oligosaccharide transport activity. OsGLUE11/Os8N3 functions as a host susceptibility factor for bacterial blight, linking GLUEs to both plant and pathogen nutrition.

The human genome contains at least two classes of glucose transporters, SLC2 and SLC5. SLC2, named GLUTs are uniporters, i.e. they transport glucose along its concentration gradient. In contrast, SGLTs are Na$^+$-coupled cotransporters that can actively import glucose driven by a sodium gradient. These transporters can explain most of the uptake activities found in humans, e.g. a GLUT2 mouse knock-out mutant shows dramatically reduced uptake capacity but surprisingly not the cellular efflux. However, bioinformatic analyses showed that animals and human genomes contain homologs of the SWEETs, registered as solute carrier family SLC50. The *C. elegans* genome contains 7 homologs of a novel class of sugar efflux transporters (SLC50), while the human genome has a single homolog, named RAG1AP1.

Sugar efflux is an essential process required for cellular exchange of carbon skeletons and energy in multicellular organisms and in interactions between organisms. Sugar efflux from the tapetum or transmitting tract of the style fuels pollen development and later on pollen tube growth. Flowers secrete sugars for nectar production to attract pollinators and plants secrete carbohydrates into the rhizosphere, potentially to feed beneficial microorganisms (T. Bisseling et al., *Science* 324, 691 (2009)). Sugar efflux carriers are required at many other sites, including the mesophyll in leaves and the seed coat (Y. Zhou et al., *Plant J.* 49, 750 (2007)). The molecular nature of the efflux transporters is unknown (S. Lalonde et al., *Annu. Rev. Plant Biol.* 55, 341 (2004)). Plant-derived sugars also provide a substrate for pathogens. The primary goal of pathogens is to access nutrients from its host plant to efficiently reproduce. Phytopathogenic bacteria in the genera *Pseudomonas* and *Xanthomonas* can live in the extracellular space (apoplasm) of plant tissue, where they acquire carbohydrates as their source of energy and carbon skeletons. Successful pathogens likely co-opt such mechanisms to alter nutrient flux (J. W. Patrick, *Aust. J. Plant Physiol.* 16, 53 (1989)). As a consequence, pathogens and plants engage in an evolutionary tug-of-war in which the plant tries to limit pathogen access to nutrients and initiates defense strategies, while the pathogen devises strategies to gain access to nutrients and suppress host immunity. Insight to the mechanisms used by pathogens to alter plant defenses is now emerging; however, little is known about how pathogens alter host physiology, notably sugar export, to support pathogen growth. The present invention has identified the existence of transporters, either vesicular or at the plasma membrane, that secrete sugars. The present invention has further identified that these plant efflux transporters are 'co-opted' by pathogens to supply their nutrient requirements (J. W. Patrick, *Aust. J. Plant Physiol.* 16, 53 (1989)). At least in the case of wheat powdery mildew, glucose is the main sugar transferred from plant host to pathogen (J. Aked, J. L. Hall, *New Phytol.* 123, 271 (1993); P. N. Sutton et al., *Planta* 208, 426 (1999); and P. N. Sutton et al., *Physiol. Plant* 129, 787 (2007)). Respective pathogen glucose/H$^+$ cotransporters have been identified (R. T. Voegele et al., *Proc. Natl. Acad. Sci. USA* 98, 8133 (2001)); in contrast, the plant sugar efflux mechanisms have previously remained elusive.

In many metabolic pathways, a transporter may function at either or both ends of a particular pathway to supply and remove the substrate and product respectively from the presence of the enzyme(s). Transport can be via passive transport, active transport, diffusion, or osmosis. Transporters may directly or indirectly be responsible for the presence or absence of a substrate from an enzyme. Transporters may be localized in or near the cell membrane, or they may be located in the cytoplasm or near or in other organelles such as the endoplasmic reticulum, mitochondria, chloroplast, peroxisomes, golgi apparatus, vesicles nuclear membrane, or vacuole, lysosome or plasma membrane.

A transporter may be stationary and allow passage of the substrate by or through it, or it may bind the substrate and physically shuttle the substrate to a particular subcellular destination. A transporter may bind one type of molecule to allow passage or transport of another type of molecule. The transporter may move independently or through the aid of other proteins, such as protein kinases or ATP-cleaving domains.

Transporters determine the uptake or emission of a substance into or out of a cell or an organism, and transporters control the transport and distribution of substances between the cells. Transporters may also function intercellularly, such as transporting between organelles, for example, in and out of the nucleus. As transporters often lie at the beginning or the end of a metabolic pathway, they thereby take charge of fundamental higher controlling functions. Transporters maybe involved in the reuptake of a released small molecule such as a monoamine or neurotransmitter.

Some transporters require energy to transport their particular substrate. In certain instances, the energy is supplied through ATP, and a resulting phosphorylation of the transporter causes a conformational change that allows the transport to proceed. In other cases, the energy is provided indirectly through coupling of the transport to a second substrate, e.g., the proton or sodium/potassium gradient created by a P or V-type ATPase. In other instances, the interaction of a transporter with another protein or molecule will cause a conformational change to allow transport of the same protein or molecule or a different protein or molecule to proceed. In yet further instances, the separation between the transporter and a regulatory protein causes a conformational change in the transporter to allow transport to proceed. A transporter may interact with a substrate or product through direct binding. During catalysis of transport, the transporter can undergo a conformational change. This also includes hybrid proteins that serve as enzymes and transporters such as P-type or V-type ATPases.

As used herein, the term "conformational change" refers to any conformational change occurring in the sensor, such as, effects on the 3D location of atoms and atom groups in the protein, the average position of movable atoms and side chains, changes in the surface properties of the protein, movements of domains folding/unfolding of domains that effects either the position/average position or conformation of a single or the relative position, average position of the fluorophore is changed resulting in a change of energy emitted by said detection portions. The term "relative position" refers to any possible kind of spatial relationship the two detection portions can have to one another such as distance and orientation. For instance, the conformation may change by rotation of one or several atoms, side chains or domains, by folding up the enzyme, by twisting one or both of the domains laterally or by any combination of these movements. Useful is a conformational change where the orientation or distance between the detection portions is altered or a change that exerts an effect on the conformation of the reporter element. Alternatively, the conformational change in the enzyme portion affects the properties of a single attached fluorophore. In this case, a second fluorophore may be used to obtain a RET signal. In such cases, it is advantageous that, either before binding or upon binding, the detection portions are oriented in a way that at least half-maximum energy transfer takes place.

As used herein, "ligand" refers to a molecule or a substance that can bind to a protein such as a periplasmic binding protein to form a complex with that protein. The binding of the ligand to the protein may distort or change the shape of the protein, particularly the tertiary and quaternary structures. A ligand maybe a substrate. A substrate may include an educt, or a reagent which is converted to a product through the assisted catalysis of the enzyme. A ligand may be an analog or derivative of an endogenous ligand. A ligand may compete with an endogenous ligand for the binding site. The ligand may be, for example, a small molecule, a chemical, a single stranded oligonucleotide, a double-stranded oligonucleotide, DNA, RNA, or a polypeptide. The ligand may be a transition analog or a product. The ligand includes any chemical bound to the protein, including an ion such as magnesium or an allosteric factor or another protein. The ligand may be a sugar, such as glucose.

As used herein, "fluorescent indicator" refers to a fluorescent domain or compound linked to the PBP. Changes in the shape of the PBP result in changes of the fluorescence of the fluorescent domain or compound, thereby indicating the change of shape in the enzyme. The domain may be a fluorescent protein. The fluorescent domain may comprise two subdomains, such as a donor and an acceptor fluorophore. In some instances, the PBP will be covalently linked in between the donor and acceptor fluorophores. Alternatives to the use of fluorescent indicators are luminescent or phosphorescent molecules, as well as compounds that may be detected by other means such as NMR, polarization detectors, etc.

As used herein with respect to proteins and polypeptides, the term "recombinant" may include proteins and/or polypeptides and/or peptides that are produced or derived by genetic engineering, for example by translation in a cell of non-native nucleic acid or that are assembled by artificial means or mechanisms.

As used herein, "fusion" may refer to nucleic acids and polypeptides that comprise sequences that are not found naturally associated with each other in the order or context in which they are placed according to the present invention. A fusion nucleic acid or polypeptide does not necessarily comprise the natural sequence of the nucleic acid or polypeptide in its entirety. Fusion proteins have the two or more segments joined together through normal peptide bonds. Fusion nucleic acids have the two or more segments joined together through normal phosphodiester bonds.

As used herein, the term "biological sample" refers to a collection of cells or cellular matter. The sample may be obtained from an organism or from components (e.g., cells) of an organism. The sample may be obtained from any biological tissue or fluid. The sample may be a sample which is derived from a subject. The subject may be a plant. The sample may be obtained from a plant or a component of a plant. The subject may be an animal. The animal may be a mammal, such as a human or a human patient. Such samples include, but are not limited to, sputum, blood, blood cells (e.g., white cells and red cells), tissue or biopsy samples (e.g., tumor biopsy), urine, peritoneal fluid, and pleural fluid, or cells therefrom. Biological samples may also include sections of tissues such as frozen sections taken for histological purposes. Biological samples may also include in vitro cell cultures. Cell cultures may be immortalized cell lines or primary cell lines. Cell cultures may include different cell types.

As used herein, the term "dsRNA" refers to double-stranded RNA, wherein the dsRNA may be double-stranded by two separate strands or by a single stranded hairpin. dsRNA may comprise a nucleotide sequence homologous to the nucleotide of a target gene. dsRNA may be produced by expression vectors (also referred to as RNAi expression vectors) capable of giving rise to transcripts which form self-complementary dsRNAs, such as hairpin RNAs or dsRNA formed by separate complementary RNA strands in cells, and/or transcripts which can produce siRNAs in vivo. Vectors may include a transcriptional unit comprising an assembly of (1) genetic element(s) having a regulatory role in gene expression, for example, promoters, operators, or enhancers, operatively linked to (2) a "coding" sequence which is transcribed to produce a double-stranded RNA (two RNA moieties that anneal in the cell to form an siRNA, or a single hairpin RNA which can be processed to an siRNA), and (3) appropriate transcription initiation and termination sequences. The choice of promoter and other regulatory elements generally varies according to the intended host cell. In general, expression vectors of utility in recombinant DNA techniques are often in the form of "plasmids" which refer to circular double stranded DNA loops which, in their vector form are not bound to the chromosome.

As used herein, the term "isolated" refers to molecules separated from other cell/tissue constituents (e.g. DNA or RNA), that are present in the natural source of the macromolecule. The term "isolated" as used herein also refers to a nucleic acid or peptide that is substantially free of cellular material, viral material, and culture medium when produced by recombinant DNA techniques, or that is substantially free of chemical precursors or other chemicals when chemically synthesized. Moreover, an "isolated nucleic acid" may include nucleic acid fragments which are not naturally occurring as fragments and would not be found in the natural state.

As used herein, the term "multimer" refers to formation of a multimeric complex between two or more distinct molecules. The multimer complex may comprise, for example, two or more molecules of the same protein (e.g., a homo-dimer, -trimer, -tetramer, dimer of dimers or higher order multimer) or a mixture of two or more different (i.e., non-identical) proteins (e.g. a hetero-dimer, dimer of different dimers, -trimer, -tetramer or higher multimer). For example, multimeric antibodies may comprise the same antibody or two or more different antibodies, each of which have two or more functions or activities (e.g., bind to two or more epitopes).

As used herein, "subject" may include a recipient of the invention. The subject can be a plant, or a component of a plant, such as a plant organ or organelle. The subject can be any animal, including a vertebrate. The subject will in most cases, preferably be a human, but may also be a domestic livestock, laboratory animal (including but not limited to, rodents such as a rat or mouse) or pet animal.

As used herein, the term "variant" refers to polypeptides with at least about 70%, more preferably at least 75% identity, including at least 80%, 90%, 95%, 96%, 97%, 98%, 99%, or greater identity to native molecules by BLAST analysis. Many such variants are known in the art, or can be readily prepared by random or directed mutagenesis of a native fluorescent molecules (see, for example, Fradkov et al., FEBS Lett. 479:127-130 (2000).

As used herein, the term, "plasmid" and "vector" are used interchangeably as the plasmid is the most commonly used form of vector. However, the invention is intended to include such other forms of expression vectors which serve equivalent functions and which become known in the art subsequently hereto. A vector may be any of a number of nucleic acids into which a desired sequence may be inserted by restriction and ligation for transport between different genetic environments or for expression in a host cell. Vectors are typically composed of DNA, although RNA vectors are also available. Vectors include, but are not limited to, plasmids and phagemids. A cloning vector is one which is able to replicate in a host cell, and which is further characterized by one or more endonuclease restriction sites at which the vector may be cut in a determinable fashion and into which a desired DNA sequence may be ligated such that the new recombinant vector retains its ability to replicate in the host cell. In the case of plasmids, replication of the desired sequence may occur many times as the plasmid increases in copy number within the host bacterium or just a single time per host before the host reproduces by mitosis. In the case of phage, replication may occur actively during a lytic phase or passively during a lysogenic phase.

Vectors may further contain a promoter sequence. A promoter may include an untranslated nucleic acid sequence usually located upstream of the coding region that contains the site for initiating transcription of the nucleic acid. The promoter region may also include other elements that act as regulators of gene expression. In further embodiments of the invention, the expression vector contains an additional region to aid in selection of cells that have the expression vector incorporated. The promoter sequence is often bounded (inclusively) at its 3' terminus by the transcription initiation site and extends upstream (5' direction) to include the minimum number of bases or elements necessary to initiate transcription at levels detectable above background. Within the promoter sequence will be found a transcription initiation site, as well as protein binding domains responsible for the binding of RNA polymerase. Eukaryotic promoters will often, but not always, contain "TATA" boxes and "CAT" boxes. Activation of promoters may be specific to certain cells or tissues, for example by transcription factors only expressed in certain tissues, or the promoter, may be ubiquitous and capable of expression in most cells or tissues.

Vectors may further contain one or more marker sequences suitable for use in the identification and selection of cells which have been transformed or transfected with the vector. Markers include, for example, genes encoding proteins which increase or decrease either resistance or sensitivity to antibiotics or other compounds, genes which encode enzymes whose activities are detectable by standard assays known in the art (e.g., β-galactosidase or alkaline phosphatase), and genes which visibly affect the phenotype of transformed or transfected cells, hosts, colonies or plaques. Vectors may be those capable of autonomous replication and expression of the structural gene products present in the DNA segments to which they are operably joined.

An expression vector is one into which a desired nucleic acid sequence may be inserted by restriction and ligation such that it is operably joined or operably linked to regulatory sequences and may be expressed as an RNA transcript. Expression refers to the transcription and/or translation of an endogenous gene, transgene or coding region in a cell.

A coding sequence and regulatory sequences are operably joined when they are covalently linked in such a way as to place the expression or transcription of the coding sequence under the influence or control of the regulatory sequences. If it is desired that the coding sequences be translated into a functional protein, two DNA sequences are said to be operably joined if induction of a promoter in the 5' regulatory sequences results in the transcription of the coding sequence and if the nature of the linkage between the two DNA sequences does not (1) result in the introduction of a frame-shift mutation, (2) interfere with the ability of the promoter region to direct the transcription of the coding sequences, or (3) interfere with the ability of the corresponding RNA transcript to be translated into a protein. Thus, a promoter region would be operably joined to a coding sequence if the promoter region were capable of effecting transcription of that DNA sequence such that the resulting transcript might be translated into the desired protein or polypeptide.

Some aspects of the present invention include the transformation and/or transfection of nucleic acids. Transformation is the introduction of exogenous or heterologous nucleic acid to the interior of a prokaryotic cell. Transfection is the introduction of exogenous or heterologous nucleic acid to the interior of a eukaryotic cell. The transforming or transfecting nucleic acid may or may not be integrated (covalently linked) into chromosomal DNA making up the genome of the cell. In prokaryotes, for example, the transforming nucleic acid may be maintained on an episomal element such as a plasmid or viral vector. With respect to eukaryotic cells, a stably transfected cell is one in which the transfecting nucleic acid has become integrated into a chromosome so that it is inherited by daughter cells through chromosome replication. This stability is demonstrated by the ability of the eukaryotic cell to establish cell lines or clones comprised of a population of daughter cells containing the transfected nucleic acid.

As used herein, the term "fusion protein" or "chimeric protein" is used to refer to a polypeptide comprising at least two polypeptides fused together either directly or with the use of spacer amino acids. The fused polypeptides may serve collaborative or opposing roles in the overall function of the fusion protein.

As used herein, "fragments" of antibodies include but are not limited to Fc, Fab, Fab', F(ab')$_2$ and single chain immunoglobulins.

As used herein, the term an "immunologically effective amount" means that the administration of that amount to a subject, either in a single dose or as part of a series, is effective for treatment of a disease or disorder. This amount varies depending upon the health and physical condition of the subject to be treated, the species of the subject to be treated (e.g. non-human mammal, primate, etc.), the capacity of the subject's immune system to synthesize antibodies, the degree of protection desired, the formulation of the vaccine and other relevant factors. It is expected that the amount will fall in a relatively broad range that can be determined through routine trials.

As used herein, "pharmaceutical composition" or "formulation" refers to a composition comprising an agent or compound together with a pharmaceutically acceptable carrier or diluent. A pharmaceutically acceptable carrier includes, but is not limited to, physiological saline, ringers, phosphate buffered saline, and other carriers known in the art. Pharmaceutical compositions may also include stabilizers, anti-oxidants, colorants, and diluents. Pharmaceutically acceptable carriers and additives are chosen such that side effects from the pharmaceutical agent are minimized and the performance of the agent is not canceled or inhibited to such an extent that treatment is ineffective.

As used herein, "therapeutically effective amount" refers to that amount of the agent or compound which, when administered to a subject in need thereof, is sufficient to effect treatment. The amount of antibodies such as cross-linked Aβ oligomer reactive antibodies which constitutes a "therapeutically effective amount" will vary depending on the severity of the condition or disease, and the age and body weight of the subject to be treated, but can be determined routinely by one of ordinary skill in the art having regard to his/her own knowledge and to this disclosure.

A "cofactor" refers to an element that interacts with a protein to assist that protein in executing its physiological function. A cofactor may catalyze a reaction. A cofactor may associate with a protein, for example a transporter or an enzyme, either through strong interactions, or through a loose association. A cofactor may be a "coenzyme" or a "prosthetic group." A "coenzyme" refers to organic molecules that shuttle or carry chemical groups between enzymes. A "prosthetic group" refers to a cofactor that binds an enzyme to become a part of the enzyme. A cofactor may also be a metal ion, such as calcium, magnesium, manganese, iron, potassium, sodium, aluminum, copper, nickel, selenium, molybdenum, or zinc. The limited supply of a cofactor may be a rate-limiting element.

The term "biological fluid" includes any bodily fluid that contains circulating proteins, including plasma, serum and whole blood, saliva, cerbrospinal fluid, amniotic fluid, synovial fluid, aqueous humour, bile, cerumen, Cowper's fluid, chyle, chyme, female ejaculate and vaginal lubrication, interstitial fluid, lymph fluid, menses, mucus, pleural fluid, pus, sebum, semen, sweat, tears, vomit, urine, lactation fluids and other secretions. A protein-containing extract of a biological fluid is any preparation that is collected or separated from a biological fluid, such as immunoglobulin fractions. Blood, serum or plasma that may be used in the present invention may be freshly obtained from an individual, or it may be obtained from such sources as pooled blood or plasma preparations obtained from blood banks or other blood collection facilities. For the purposes of the present invention, the blood, serum or plasma may also be from collections that are out-of-date or otherwise found to be substandard by blood banks or blood collection facilities. Identical process of this invention can be applied to animal blood and should result in obtaining analogous animal antibodies for purposes relating to veterinary medicine. Fluids may be used in their whole state as it is obtained, or may be further processed such as through allowing sedimentation or by centrifugation. The fluid may be from a plant, such as a sap, phloem sap, zylem sap, nectar, resin, latex, or oil. The fluid may be a supernatant, a collected sediment, or a pellet obtained by extra-gravitational forces, such as centrifugation or filtration.

The present invention is based in part on the discovery of a novel class of sugar transporter proteins. The sugar may be a mono-, di-, or oligosaccharide, such as glucose, fructose, ribose, lactose, galactose, arabinose, maltose, amylose, cellulose, or sucrose. The transporters may transport sugars across a membrane in a cell. The membrane may be a plasma membrane or a cell wall. The membrane may surround the cytoplasm of a cell. The membrane may surround a cellular organelle, such as a mitochondrium, an endoplasmic reticulum, a golgi apparatus, a nucleus, an endosome, or a vacuole. The transporter may transport sugars between the membranes of one cell/orhganelle, and the membrane of another cell/organelle.

The present invention may provide for methods of transporting sugar in an organ or in between organs of a subject. The organ may be involved in the processing, importation, or exportation of carbohydrates, such as sugar and glucose. The organ may be involved in the digestive system. For example, the organ may be an intestine (large or small), a stomach, or a liver. The transporters of the present invention may assist in transporting sugar in or out of a cell with an organ. The transporter may work collectively with other proteins known to operate in moving sugars, such as SGLT, GLUT1, and GLUT2. The transporters may efflux sugar out of an organelle. The transporters may efflux sugar passively through the formation of vescies. For example, expression of the transporters in a golgi apparatus may allow for efflux of sugar into forming vescies that then passively migrate their contents out of the cell.

Originally it was thought that the glucose uniporter GLUT2 is responsible both for import and efflux of glucose in liver and intestine. However, knock down of GLUT2 in hepatocytes and in transgenic mice showed that GLUT2 is essential for glucose uptake but not for glucose efflux. Oral glucose load of GLUT2 knock out mice resulted in normal rates of glucose appearance in the blood (Thorens et al. *J. Biol. Chem.* 275, 23751-23758, (2000)). Similarly, persons affected by with Fanconi-Bickel syndrome, a syndrome caused by inactivation in both GLUT2 alleles (Santer et al. *Nat. Genet.* 17, 324-326, (1997)), did not lead to abnormal carbohydrate ingestion, a process that requires efflux from intestinal cells (Manz, F. et al. *Pediatr Nephrol* 1, 509-518, (1987)). Based on its function, HsSWEET1/RAG1AP1 may assist in efflux of sugar, such as glucose, from liver.

The transporter, for example a GLUE transporter, may be located in a membrane. The transporter may span a membrane. The transporter may comprise a pore through the membrane. Sugar transportation may be through a pore in the membrane created by the transporter. The pore may be capable of varying in width in response to stimuli, thereby altering the ability of sugar to pass through the pore. The transporter may be gated. The gating mechanism will allow passage of sugar through the transporter in response to a stimulus. The gating mechanism may require a ligand to bind or may involve a voltage sensor. The transporter may allow passage of a sugar by passive diffusion. The transporter may require energy, such as adenosine triphosphate, in order to transport a sugar. The transporter may transport sugar from high to low concentration in an attempt to reach an equilibrium. The transporter may transport sugar from an area of low concentration to a higher concentration, thereby increasing a gradient. The transporter may be a uniporter. A uniporter, as used herein, refers to a transporter that functions as a facilitator and the direction of transporter is determined on the gradient or concentration differential across the membrane of the substrate being transported. A uniporter refers to a transporter that is able to operate self-sufficiently, without relying on a cofactor such as a cotransported molecule or an activating molecule. A uniporter will typically allow flow of a sugar in the direction of a concentration gradient, i.e., from a side with a high concentration of sugar to a side with a low concentration of sugar.

The transporter, for example a GLUE transporter, may increase sugar concentration on one side of a membrane. The transporter may increase sugar levels inside a cell. This could be achieved through coupling of the transport to the transport of second compound, which can be an ion or another metabolite, such as a proton, hydroxy-anion, sodium or potassium. Coupling may be by cotransport or antiport or by a ping-pong mechanism. The transporter may decrease sugar concentrations within a cell. The transporter may export sugar from a cell. The transporter may import sugar into a cell.

The transporter may further be affected by a signal, such as a kinase, a second messenger, an anion, a cation, or a ligand. The transporter may be affected by a cofactor. The cofactor may be an ion, such as ionized forms of magnesium, zinc, iron, copper, iodine, chloride, sodium, potassium, calcium, manganese, sulfate, sulfate, ammonium, nitrate, nitrite, carbonate, carboxylic acid, or phosphate. The cofactor may be necessary to assist substrate or ligand binding to the transporter or to a second messenger. The cofactor may be necessary for the activity of the transporter. In some instances, failing to add a cofactor will provide a non-functioning or lesser-functioning transporter. In other instances, the presence of a cofactor will down-regulate the activity of the transporter. The transporter may be down-regulated through internalization, such as through the clathrin internalization mechanism.

The transporter may be in a cell or extract obtained from a cell. The cell may be in a prokaryote. The cell may be in an eukaryote.

The cell may be in an animal or a rt thereof. The transporter may play a role in transporting glucose in the endoplasmic reticulum, golgi apparatus, vesicles or plasma membrane of an animal cell. The cell may be an animal cell that is involved in glucose transport or secretion. The cell may be a glandular cell. The glandular cell may be an alveolar cell of the mammary gland.

The cell may be in a plant or a part thereof, such as a root, stem, leaf, seed, flower, fruit, anther, nectary, ovary, petal, tapetum, xylem, or phloem. By way of example, plants include embryophytes, bryophytes, spermatophyes, nematophytes, tracheophytes, soybean, rice, tomato, alfalfa, potato, pea, grasses, herbs, trees, algae, mosses, fungi, vines, ferns, bushes, barley, wheat, hops, maize, lettuce, orange, peach, citrus, lemon, lime, coconut, palm, pine, oak, cedar, mango, pineapple, rhubarb, strawberry, blackberry, blackcurrant, blueberry, raspberry, kiwi, grape, rutabega, parsnip, sweet potato, turnip, mushroom (Fungus), pepper, cilantro, onion, leek, fennel, clove, avocado, or cucumber. It also includes biofuel crops such as *Miscanthus* or switchgrass, poplar, *Sorghum*, and *Brachypodium*.

The transporters of the present invention, for example GLUE transporters, may transport sugar, specifically mon-, di- or oligosaccharides e.g. glucose or sucrose, within an organism, such as a plant or animal. In plants, the transporters may transport sugars for the production of nectar. The transporters may transport sugar to and/or from the nectaries of a plant. The transporters of the present invention may be localized to the nectaries. As used herein, a "nectary" refers to a secretory structure that produces nectar. Nectar is a composition comprising glucose and/or fructose and/or other saccharides which may serve as a reward for pollinators.

The transporters may transport sugar to and/or from the anther of a plant. The anther refers to a reproductive organ of a plant, comprised of a stamen and a filament. The transporters of the present invention may be localized to the anther. The transporters of the present invention may be localized to the stamen and/or filament of the anther. They may localize to the tapetum or the pollen itself. In the pollen they may localize to the vegetative or generative cells. The presence of the transporters of the present invention may affect the functioning of the anther. The functioning of the transporters in the tapetum may play a role in pollen nutrition. The functioning in the pollen may help nourish the generative cells. The functioning in the anther may cause a sudden hydrolysis of starch, which may lead to an increase in the osmotic potential, which in turn may lead to retraction of water from surrounding tissues, which may then promote dehydration and dehiscence of the anther. The functioning may also contribute to uptake of sugars into the pollen or release of sugar in the transmitting tract or epididymis.

The transporters of the present invention may transport sugar to and/or from the sporangium of a plant, such as a microsporangium or a megasporangium. The transporters of the present invention may be localized to a sporangium or spore releasing reproductive gland. The transporters may affect the function of a sporangium.

The transporters of the present invention may transport sugar to and/or from the transmission tract to supply the elongating pollen tube with nutrients and energy.

The transporters of the present invention may mediate uptake across the plasma membrane and 'efflux' into the ER. The transporters of the present invention may function as a glucose uniporter, for which the direction of transport depends only on the glucose gradient across the membrane.

The transporters, such as a GLUE transporter, may induce development of the phloem cells. The transporters may be localized to the phloem. The transporters may affect the function of a phloem cell. The phloem refers to tissue involved in transporting nutrients, such as sap, in a cell. The phloem may transport nutrients from a certain region, such as a root or a sugar source of a plant, to another region of a plant, such as a leaf or a sugar sink of a plant. Transport along the phloem may be multi-directional or unidirectional. The phloem may comprise parenchyma cells, sieve-tube cells, mesophyll cells and companion cells, such as ordinary companion cells, transfer cells and intermediary cells. The phloem may further comprise albuminous cells, fibers and sclereids.

The transporters of the present invention may affect the disease-susceptibility of an organism, such as a plant or animal. The transporters of the present invention may affect the susceptibility of a plant to a pathogen, such as a virus or bacteria or insect. It is known that pathogens may affect gene transcription of a host cell. The pathogen may affect gene transcription of sugar transporters. The present invention provides for novel methods to protect the host cell. They may affect the nutrition of both symbionts and pathogens above and below ground. They may attract microorganisms. They may play a role in secreting sugars into soil. They thus may affect the microflora around the root as well as the productivity of the plant. They may affect the interaction with pollinators. They may play a role in supplying sugars to cells in the plant that depend on external supply, such as epidermis, guard cells, seeds.

Transporter Proteins

The present invention provides for a continuous sequence of polypeptides that collectively function in the passage of sugar across a membrane. The transporters may be imbedded in or completely traverse a membrane. The transporter may traverse a membrane multiple times, such as 2, 3, 4, 5, 6, 7, or more times. Those skilled in the art will appreciate that the portions of a transporter that cross a membrane will vary in hydrophobicity and hydrophilicity as compared with those portions of the transporter positioned on the exterior (either side, such as extracellular and intracellular) of the membrane. The transporters may comprise at least 2 sub-units, such as two transmembrane proteins, for example, a homo or heterotrimer, wherein the term "trimer" refers to the number of times the protein spans across a membrane. In further instances the subunits may be connected by a linker peptide, such as a further intracellular domain, a further extracellular domain or a further transmembrane domain.

The transporters may form a pore. The pore may be formed by a spherical arrangement of the transmembrane domains of the transporter or the sub-domains thereof. The pore may allow passage of a sugar through it. The pore may be selective for passage of sugar only. The pore may have a selective point or points which restrict passage to certain sized or certain shaped molecules. Passage through the pore may be based on a concentration gradient only. The pore may further be opened or closed based on the activity of a cofactor, such as activity of an interacting protein, or the binding of an ion or the presence of a charge, such as a negative or positive charge.

The present invention also provides chimeric transporters. Chimeric are a combination of functional domains derived from two or, more different proteins. Chimeric transporters may fuse the pore of the transporter to a second messenger interacting/recruiting domain from another membrane associated protein, such as a receptor tyrosine kinase, a G-protein coupled receptor, an aquaporin, or another transporter.

The chimeric transporter may be a fusion of two or more of the transporters described herein. By way of example, transporters may include, glucose transporters, glutamate transporters (sodium dependent and vesicular), aquaporins, Na/K ATPase, serotonin transporter (SERT), dopamine transporter (DAT), norepinephrine transporter (NET), ammonium transporters, and potassium channels.

The present invention also provides fusion proteins of the transporters. For example, a known epitope or tag may be fused to the transporter. The tag may be a fluorescent tag, such as a green fluorescent protein, red fluorescent protein, orange fluorescent protein, yellow fluorescent protein, cyan fluorescent protein, or blue fluorescent protein. Methods for preparing fusion proteins are known in the art.

The present invention provides for transporters that may provide for transport of a sugar. The transport may be across a membrane. The transport may be exporting a sugar from a cell or from an organelle within a cell. The transport may be importing a sugar into a cell or an organelle within a cell. The sugar may be a mono-, di-, or oligo-saccharide or derivative thereof. For example, sugars may include ribose, arabinose, a pentose, such as glucose, fructose, galactose, and mannose, hexose, such as maltose and sucrose. Disaccharides may include raffinose and stachyose. Derivates may include glycosyl-derivatives of amino acids and hormones The present invention also provides nucleic acids encoding the transporters of the present invention, such as GLUE transporters. The present invention discloses several cDNAs that encode the transporters of the present invention. The protein MtN3 from Medicago and homologs thereof may function as a GLUE. In *Arabidopsis*, the following Accession Nos: encode transporters: AT4G15920, AT3G16690, AT5G13170, AtSAG29, AT4G25010, AT5G50800, AT5G23660, AT3G48740, AT5G50790, AT2G39060, AT5G40260, AtRPG1, AT4G10850, AT1G66770, AT5G62850, AtVEX1, AT3G28007, AT3G14770, AT1G21460, and AT5G53190 (all of which are herein incorporated by reference in their entirety). In *Petunia* plants, NEC1 is an example of a sugar transporter (which is herein incorporated by reference in their entirety). In *Medicago* plants, the following cDNA Accession Nos that encode the transporters of the present invention have been identified: AC202585, AC147714, MtC60432 GC, MtC11004 GC, CT963079, MtD03138 GC, TC 125536, AC146866, AC189276, TC129646, CAA69976 MtNod3 AC2456, TC115479, AC146747, MtC10424 GC, CT954252, CU302340, AC202585, AC147714, MtC60432 GC, MtC11004 GC, and CT963079 (all of which are herein incorporated by reference in their entirety). In rice plants, the following cDNA Accession Nos that encode the transporters of the present invention have been identified: Os08g42350 (Os8N3) Os08g0535200, Os12g29220 Os03g0347500, Os05g51090 Os05g0588500, Os12g07860, Os09g08440, Os09g08490, Os09g08270, Os09g08030 Os09g0254600, Os01g42090.1 Os01g0605700, Os01g42110.1 Os01g060600, Os02g19820 Os02g03110, Os05g35140 Os05g0426000, Os01g65880 Os01g0881300, Os01g50460 Os01g0700100,) s01g36070.1 Os01g0541800, Os01g12130.1, Os05g12320 Os05g0214300, and Os01g21230 (all of which are herein incorporated by reference in their entirety).

The invention also comprises the animal homologs RAG1AP1 as well the bacterial homologs of this family such as those encoded by the following accession nos: A1BJ76 (SEQ ID NO: 91), A1VHH8 (SEQ ID NO: 92), A3IH65 (SEQ ID NO: 93), A4AVY5 (SEQ ID NO: 94), A5ERR3 (SEQ ID NO: 95), A5FEJ3 (SEQ ID NO: 96), A5G4U0 (SEQ ID NO: 97), A5IEV6 (SEQ ID NO: 98), A8AYJ9 (SEQ ID NO: 99), B0SHL1 (SEQ ID NO: 100), B0SR19 (SEQ ID NO: 101), B1MYL5 (SEQ ID NO: 102), B1MZF9 (SEQ ID NO: 103), B1WTC6 (SEQ ID NO: 104), B3EHG6 (SEQ ID NO: 105), B5EHF6 (SEQ ID NO: 106), B5YGD6 (SEQ ID NO: 107), B6IU72 (SEQ ID NO: 108), Q11VQ0 (SEQ ID NO: 109), Q39VX0 (SEQ ID NO: 110), Q3B6J0 (SEQ ID NO: 111), Q5WTV4 (SEQ ID NO: 112), Q5X228 (SEQ ID NO: 113), Q72RB5 (SEQ ID NO: 114), Q72FY5 (SEQ ID NO: 115), Q89G85 (SEQ ID NO: 116), Q8F4F7 (SEQ ID NO: 117) (all of which are herein incorporated by reference in their entirety). GLUEs may be obtained from prokaryotes such as *Legionella, Desulfovibrio, Bradyrhizobium, Leptospira, Rhodopseudomonas, Streptococcus, Geobacter, Pelodictyon, Cytophaga, Rhodospirillum, Thermodesulfovibrio, Chlorobium, Wolbachia, Cyanothece, Leuconostoc,* and *Flavobacterium.*

The transport of sugars is essential. For example, a glucose efflux is needed at many points in the body of an organism, for example in the development of pollen or in the role of the epididymis feeding developing sperm cells. GLUEs may be upregulated during certain physiological processes, such as during lactation, and may be localized to the glandular cells that secrete lactose into the milk duct. Similarly, organs such as the liver, needs to efflux glucose to keep blood glucose levels constant. The GLUEs may be involved in loading vesicles or the Golgi with glucose for a vesicular efflux pathway.

The members of the transporter families share substantial identity. GLUE1 is 41% identical to its paralog GLUE8, and belongs to the second of the four *Arabidopsis* GLUE clades. Mutation of GLUE8/RPG1 had been shown to lead to male sterility. Coexpression of GLUE88/RPG1 with the FRET sensors for glucose in mammalian cells evidence that some GLUEs, such as GLUE8, also function as uniporters. Moreover GLUE8/RPG1 complements the yeast glucose transport mutant. GLUE8/RPG1 may be expressed in the tapetum, demonstrating a role in pollen nutrition.

GLUE1 and GLUE8 share 34% amino acid sequence identity with the rice protein OsGLUE11/Os8N3 (named OsGLUE11 based on phylogeny). The closest *Arabidopsis* homolog shares 40% identity with OsGLUE11/Os8N3 and belongs to the third GLUE clade. Similar to GLUE8, OsGLUE11/Os8N3 may function in pollen nutrition since a reduction of its expression by RNA-inhibition led to reduced starch content in pollen as well as pollen sterility. Silencing of *Petunia* Nec1, another homolog of GLUEs in clade 3 also may lead to male sterility. Nec1 is expressed in nectaries, and its developmental regulation correlated inversely with starch content of the nectaries, demonstrating a second role for Nec1 in sugar secretion in nectaries.

The present invention provides for transporters in other organisms. For example, the *C. elegans* genome contains 7 homologs of a novel class of sugar efflux transporters (SLC50), while the human genome has a single homolog, named RAG1AP1 (or HsGLUE1). Similar to the *Arabidopsis* GLUE1, *C. elegans* CeGLUE1 may mediate glucose uptake. CeGLUE1 as well as human RAG1AP1, may counteract secondary active glucose accumulation mediated by the Na$^+$/glucose cotransporter SGLT1. Mutation of CeGLUE1 as well as human RAG1AP1, may lead to fat accumulation, compatible with a defect in cellular glucose efflux leading to accumulation of lipids.

The present invention provides nucleic acids encoding the sugar transporters, such as GLUE. The present invention also provides nucleic acids that encode polypeptides with conservative amino acid substitutions. The nucleic acids of the present invention may encode polypeptides that transport sugar. The isolated nucleic acids may have at least about 30%, 40%, 50%, 60%, 70%, 80% 85%, 90%, 95%, or 99% sequence identity with the above identified sequences. The isolated nucleic acids may encode a polypeptide having an amino acid sequence having at least about 30%, 40%, 50%, 60%, 70%, 80%, 85%, 90%, 95%, or 99% sequence identity to amino acid sequences encoded by the above identified accession numbers. The isolated nucleic acid encoding a transporter may hybridize to the above identified nucleic acid sequences.

The proteins of the GLUE share sequence and subdomain homology. Table 1 below provides an illustration of the amount of sequence conservation across a selection of GLUEs and Table 2 below provides a comparison of GLUEs by sequence.

TABLE 1

Pairwise comparison of GLUEs by identity

| | GLUE1 | GLUE2 | GLUE3 | GLUE10 | GLUE15 | GLUE11 | GLUE12 | GLUE13 | GLUE14 |
|---|---|---|---|---|---|---|---|---|---|
| GLUE1 | | 40 | 40 | 33 | 33 | 35 | 35 | 37 | 36 |
| GLUE2 | | | 37 | 31 | 29 | 31 | 34 | 33 | 33 |
| GLUE3 | | | | 30 | 30 | 30 | 31 | 31 | 31 |
| GLUE10 | | | | | 45 | 44 | 44 | 46 | 44 |
| GLUE15 | | | | | | 46 | 49 | 45 | 44 |
| GLUE11 | | | | | | | 86 | 56 | 55 |
| GLUE12 | | | | | | | | 58 | 57 |
| GLUE13 | | | | | | | | | 75 |
| GLUE14 | | | | | | | | | |
| GLUE9 | | | | | | | | | |
| GLUE16 | | | | | | | | | |
| GLUE17 | | | | | | | | | |
| GLUE4 | | | | | | | | | |
| GLUE5 | | | | | | | | | |
| GLUE6 | | | | | | | | | |
| GLUE7 | | | | | | | | | |
| GLUE8 | | | | | | | | | |

| | GLUE9 | GLUE16 | GLUE17 | GLUE4 | GLUE5 | GLUE6 | GLUE7 | GLUE8 |
|---|---|---|---|---|---|---|---|---|
| GLUE1 | 31 | 36 | 38 | 39 | 40 | 39 | 42 | 41 |
| GLUE2 | 32 | 33 | 32 | 32 | 30 | 34 | 33 | 31 |

TABLE 1-continued

Pairwise comparison of GLUEs by identity

| | | | | | | | | |
|---|---|---|---|---|---|---|---|---|
| GLUE3 | 31 | 36 | 34 | 35 | 32 | 33 | 34 | 34 |
| GLUE10 | 44 | 33 | 34 | 32 | 31 | 30 | 32 | 31 |
| GLUE15 | 44 | 35 | 35 | 34 | 33 | 30 | 32 | 34 |
| GLUE11 | 47 | 36 | 36 | 32 | 30 | 30 | 32 | 34 |
| GLUE12 | 47 | 35 | 35 | 34 | 31 | 32 | 32 | 35 |
| GLUE13 | 45 | 32 | 33 | 30 | 30 | 28 | 30 | 33 |
| GLUE14 | 45 | 32 | 33 | 31 | 31 | 28 | 30 | 33 |
| GLUE9 | | 33 | 36 | 35 | 30 | 35 | 36 | 32 |
| GLUE16 | | | 72 | 40 | 35 | 34 | 38 | 38 |
| GLUE17 | | | | 39 | 37 | 35 | 38 | 37 |
| GLUE4 | | | | | 58 | 48 | 47 | 44 |
| GLUE5 | | | | | | 46 | 49 | 44 |
| GLUE6 | | | | | | | 74 | 40 |
| GLUE7 | | | | | | | | 43 |
| GLUE8 | | | | | | | | |

TABLE 2

Pairwise comparison of GLUEs by sequence

| | GLUE1 | GLUE2 | GLUE3 | GLUE10 | GLUE15 | GLUE11 | GLUE12 | GLUE13 | GLUE14 |
|---|---|---|---|---|---|---|---|---|---|
| GLUE1 | | 58 | 57 | 54 | 54 | 53 | 53 | 55 | 53 |
| GLUE2 | | | 54 | 52 | 52 | 53 | 54 | 56 | 54 |
| GLUE3 | | | | 55 | 54 | 51 | 54 | 51 | 54 |
| GLUE10 | | | | | 65 | 65 | 65 | 66 | 64 |
| GLUE15 | | | | | | 66 | 68 | 64 | 64 |
| GLUE11 | | | | | | | 92 | 71 | 71 |
| GLUE12 | | | | | | | | 74 | 74 |
| GLUE13 | | | | | | | | | 86 |
| GLUE14 | | | | | | | | | |
| GLUE9 | | | | | | | | | |
| GLUE16 | | | | | | | | | |
| GLUE17 | | | | | | | | | |
| GLUE4 | | | | | | | | | |
| GLUE5 | | | | | | | | | |
| GLUE6 | | | | | | | | | |
| GLUE7 | | | | | | | | | |

| | GLUE9 | GLUE16 | GLUE17 | GLUE4 | GLUE5 | GLUE6 | GLUE7 | GLUE8 |
|---|---|---|---|---|---|---|---|---|
| GLUE1 | 50 | 54 | 55 | 55 | 56 | 61 | 61 | 58 |
| GLUE2 | 58 | 54 | 54 | 56 | 56 | 56 | 56 | 56 |
| GLUE3 | 51 | 58 | 56 | 56 | 55 | 53 | 54 | 57 |
| GLUE10 | 69 | 56 | 56 | 58 | 56 | 53 | 56 | 57 |
| GLUE15 | 69 | 62 | 59 | 57 | 58 | 52 | 56 | 60 |
| GLUE11 | 69 | 60 | 61 | 52 | 56 | 50 | 51 | 52 |
| GLUE12 | 68 | 59 | 60 | 53 | 58 | 53 | 54 | 52 |
| GLUE13 | 66 | 57 | 57 | 51 | 54 | 52 | 53 | 53 |
| GLUE14 | 64 | 55 | 55 | 53 | 56 | 54 | 54 | 53 |
| GLUE9 | | 61 | 60 | 55 | 55 | 56 | 58 | 57 |
| GLUE16 | | | 84 | 58 | 55 | 54 | 56 | 57 |
| GLUE17 | | | | 56 | 56 | 54 | 57 | 57 |
| GLUE4 | | | | | 74 | 64 | 64 | 60 |
| GLUE5 | | | | | | 68 | 70 | 61 |
| GLUE6 | | | | | | | 86 | 62 |
| GLUE7 | | | | | | | | 63 |

The nucleic acid encoding the GLUE proteins may be genetically fused to expression control sequences for expression. Suitable expression control sequences include promoters that are applicable in the target host organism. Such promoters are well known to the person skilled in the art for diverse hosts from prokaryotic and eukaryotic organisms and are described in the literature. For example, such promoters may be isolated from naturally occurring genes or may be synthetic or chimeric promoters. Likewise, the promoter may already be present in the target genome and may be linked to the nucleic acid molecule by a suitable technique known in the art, such as for example homologous recombination.

The present invention also provides expression cassettes for inserting the nucleic acid encoding a GLUE into target nucleic acid molecules such as vectors or genomic DNA. For this purpose, the expression cassette is provided with nucleotide sequences at the 5'- and 3'-flanks to facilitate removal from and insertion into specific sequence positions like, for instance, restriction enzyme recognition sites or target sequences for homologous recombination as, e.g. catalyzed by recombinases.

The present invention also relates to vectors, particularly plasmids, cosmids, viruses and bacteriophages used conventionally in genetic engineering, that comprise a nucleic acid molecule or an expression cassette of the invention.

In a preferred embodiment of the invention, the vectors of the invention are suitable for the transformation of fungal cells, plant cells, cells of microorganisms (i.e. bacteria, protists, yeasts, algae etc.) or animal cells, in particular mammalian cells. Preferably, such vectors are suitable for the transformation of human cells. Methods which are well known to those skilled in the art can be used to construct recombinant vectors; see, for example, the techniques described in Sambrook and Russell, Molecular Cloning: A Laboratory Manual, CSH Press, 2001, and Ausubel, Current Protocols in Molecular Biology, Green Publishing Associates and Wiley Interscience, N.Y., 1989. Alternatively, the vectors may be liposomes into which the nucleic acid molecules or expression cassettes of the invention can be reconstituted for delivery to target cells. Likewise, the term "vector" refers to complexes containing such nucleic acid molecules or expression cassettes which furthermore comprise compounds that are known to facilitate gene transfer into cells such as polycations, cationic peptides and the like.

In addition to the nucleic acid molecule or expression cassette of the invention, the vector may contain further genes such as marker genes which allow for the selection of said vector in a suitable host cell and under suitable conditions. Generally, the vector also contains one or more origins of replication. The vectors may also comprise terminator sequences to limit the length of transcription beyond the nucleic acid encoding the transporters of the present invention.

Advantageously, the nucleic acid molecules contained in the vectors are operably linked to expression control sequences allowing expression, i.e. ensuring transcription and synthesis of a translatable RNA, in prokaryotic or eukaryotic cells.

For genetic engineering, e.g. in prokaryotic cells, the nucleic acid molecules of the invention or parts of these molecules can be introduced into plasmids which permit mutagenesis or sequence modification by recombination of DNA sequences. Standard methods (see Sambrook and Russell, Molecular Cloning: A Laboratory Manual, CSH Press, 2001) allow base exchanges to be performed or natural or synthetic sequences to be added. DNA fragments can be connected to each other by applying adapters and linkers to the fragments. Moreover, engineering measures which provide suitable restriction sites or remove surplus DNA or restriction sites can be used. In those cases, in which insertions, deletions or substitutions are possible, in vitro mutagenesis, "primer repair", restriction or ligation can be used. Sequence analysis, restriction analysis and other methods of biochemistry and molecular biology are carried out as analysis methods.

The present invention also provides for directed expression of nucleic acids encoding the transporters. It is known in the art that expression of a gene can be regulated through the presence of a particular promoter upstream (5') of the coding nucleotide sequence. Tissue specific promoters for directing expression in a particular tissue in an animal are known in the art. For example, databases collect and share these promoters (Chen et al., Nucleic Acids Res. 34: D104-D107, 2006). In plants, promoters that direct expression in the roots, seeds, or fruits are known.

The present invention further provides isolated polypeptides comprising transporters fused to additional polypeptides. The additional polypeptides may be fragments of a larger polypeptide. In one embodiment, there are one, two, three, four, or more additional polypeptides fused to the transporter. In some embodiments, the additional polypeptides are fused toward the amino terminus of the transporter. In other embodiments, the additional polypeptides are fused toward the carboxyl terminus of the transporter. In further embodiments, the additional polypeptides flank the transporter. In some embodiments, the nucleic acid molecules encode a fusion protein comprising nucleic acids fused to the nucleic acid encoding the transporter. The fused nucleic acid may encode polypeptides that may aid in purification and/or immunogenicity and/or stability without shifting the codon reading frame of the transporter. In some embodiments, the fused nucleic acid will encode for a polypeptide to aid purification of the transporter. In some embodiments the fused nucleic acid will encode for an epitope and/or an affinity tag. In other embodiments, the fused nucleic acid will encode for a polypeptide that correlates to a site directed for, or prone to, cleavage. In preferred embodiments, the fused nucleic acid will encode for polypeptides that are sites of enzymatic cleavage. In further embodiments, the enzymatic cleavage will aid in isolating the transporter.

In other embodiments, the multiple nucleic acids will be fused to the nucleic acid encoding the transporters. The fused nucleic acids may encode for polypeptides that aid purification and/or enzymatic cleavage and/or stability. In further embodiments, the fused nucleic acids will not elongate the expressed polypeptide significantly.

In some embodiments the additional polypeptides may comprise an epitope. In other embodiments, the additional polypeptides may comprise an affinity tag. By way of example, fusion of a polypeptide comprising an epitope and/or an affinity tag to a transporter may aid in purification and/or identification of the polypeptide. By way of example, the polypeptide segment may be a His-tag, a myc-tag, an S-peptide tag, a MBP tag (maltose binding protein), a GST tag (glutathione S-transferase), a FLAG tag, a thioredoxin tag, a GFP tag (green fluorescent protein), a BCCP (biotin carboxyl carrier protein), a calmodulin tag, a Strep tag, an HSV-epitope tag, a V5-epitope tag, and a CBP tag. The use of such epitopes and affinity tags is known to those skilled in the art.

In further embodiments, the additional polypeptides may provide a fusion protein comprising sites for cleavage of the polypeptide. The cleavage sites are useful for later cleaving the transporter from the fused polypeptides, such as with targeting polypeptides. As an example, a polypeptide may be cleaved by hydrolysis of the peptide bond. In some embodiments, the cleavage is performed by an enzyme. In some embodiments cleavage occurs in the cell. In other embodiments, cleavage occurs through artificial manipulation and/or artificial introduction of a cleaving enzyme. By way of example, cleavage enzymes may include pepsin, trypsin, chymotrypsin, and/or Factor Xa.

Fusion polypeptides may further possess additional structural modifications not shared with the same organically synthesized peptide, such as adenylation, carboxylation, glycosylation, hydroxylation, methylation, phosphorylation or myristylation. These added structural modifications may be further selected or preferred by the appropriate choice of recombinant expression system. On the other hand, fusion polypeptides may have their sequence extended by the principles and practice of organic synthesis.

Generally, the fusion proteins of the invention may be produced according to techniques; which are described in the prior art. For example, these techniques involve recombinant techniques which can be carried out as described in Sambrook and Russell, Molecular Cloning: A Laboratory Manual, CSH Press, 2001 or in Volumes 1 and 2 of Ausubel, Current Protocols in Molecular Biology, Current Protocols, 1994. Accordingly, the individual portions of the fusion protein may be provided in the form of nucleic acid molecules encoding them which are combined and, subsequently, expressed in a host organism or in vitro. Alternatively, the provision of the fusion protein or parts thereof may involve chemical synthesis or the isolation of such portions from naturally occurring sources, whereby the elements which may in part be produced by recombinant techniques may be fused on the protein level according to suitable methods, e.g. by chemical cross-linking for instance as disclosed in WO 94/04686. Furthermore, if deemed appropriate, the fusion protein may be modified post-translationally in order to improve its properties for the respective goal, e.g., to enhance solubility, to increase pH insensitivity, to be better tolerated in a host organism, to make it adherent to a certain substrate in vivo or in vitro, the latter potentially being useful for immobilizing the fusion protein to a solid phase etc. The person skilled in the art is well aware of such modifications and their usefulness. Illustrating examples include the modification of single amino acid side chains (e.g. by glycosylation, myristolation, phosphorylation, carbethoxylation or amidation), coupling with polymers such as polyethylene glycol, carbohydrates, etc. or with protein moieties, such as antibodies or parts thereof, or other enzymes etc.

In another embodiment of the invention, the fusion protein further comprises a targeting signal sequence. Transport of proteins to a subcellular compartment such as the chloroplast, vacuole, peroxisome, glyoxysome, cell wall or mitochondrion or for secretion into the apoplast, is accomplished by means of operably linking the nucleotide sequence encoding a signal sequence to the 5' and/or 3' region of a gene encoding the protein of interest. Targeting sequences at the 5' and/or 3' end of the structural gene may determine during protein synthesis and processing where the encoded protein is ultimately compartmentalized.

The presence of a signal sequence directs a polypeptide to either an intracellular organelle or subcellular compartment or for secretion to the apoplast. Many signal sequences are known in the art. See, for example, Becker et al., Plant Mol. Biol. 20:49 (1992); Close, P. S., Master's Thesis, Iowa State University (1993); Knox, C., et al., Plant Mol. Biol. 9:3-17 (1987); Lemer et al., Plant Physiol. 91:124-129 (1989); Frontes et al., Plant Cell 3:483-496 (1991); Matsuoka et al., Proc. Natl. Acad. Sci. 88:834 (1991); Gould et al., J. Cell. Biol. 108:1657 (1989); Creissen et al., Plant J. 2:129 (1991); Kalderon, et al. Cell 39:499-509 (1984); Steifel, et al., Plant Cell 2:785-793 (1990).

The term "targeting signal sequence" refers to amino acid sequences, the presence of which in an expressed protein targets it to a specific subcellular localization. For example, corresponding targeting signals may lead to the secretion of the expressed transporter, e.g. from a bacterial host in order to simplify its purification. Preferably, targeting of the transporter may be used to affect the concentration of a sugar in a specific subcellular or extracellular compartment. Appropriate targeting signal sequences useful for different groups of organisms are known to the person skilled in the art and may be retrieved from the literature or sequence data bases.

The transporters of the present invention may be expressed in any location in the cell, including the cytoplasm, cell surface or subcellular organelles such as the nucleus, vesicles, ER, vacuole, etc. Methods and vector components for targeting the expression of proteins to different cellular compartments are well known in the art, with the choice dependent on the particular cell or organism in which the biosensor is expressed. See, for instance, Okumoto et al. PNAS 102: 8740-8745, 2005; Fehr et al. J Fluoresc 14: 603-609, 2005, which are herein incorporated by reference in their entireties. Transport of protein to a subcellular compartment such as the chloroplast, vacuole, peroxisome, glyoxysome, cell wall or mitochondrion or for secretion into the apoplast, may be accomplished by means of operably linking a nucleotide sequence encoding a signal sequence to the 5' and/or 3' region of a gene encoding the transporter. Targeting sequences at the 5' and/or 3' end of the structural gene may determine during protein synthesis and processing where the encoded protein is ultimately compartmentalized.

If targeting to the plastids of plant cells is desired, the following targeting signal peptides can for instance be used: amino acid residues 1 to 124 of *Arabidopsis thaliana* plastidial RNA polymerase (AtRpoT 3) (Plant Journal 17: 557-561, 1999); the targeting signal peptide of the plastidic Ferredoxin: NADP+ oxidoreductase (FNR) of spinach (Jansen et al., Current Genetics 13: 517-522, 1988) in particular, the amino acid sequence encoded by the nucleotides −171 to 165 of the cDNA sequence disclosed therein; the transit peptide of the waxy protein of maize including or without the first 34 amino acid residues of the mature waxy protein (Klosgen et al., Mol. Gen. Genet. 217: 155-161, 1989); the signal peptides of the ribulose bisphosphate carboxylase small subunit (Wolter et al., PNAS 85: 846-850, 1988; Nawrath et al., PNAS 91: 12760-12764, 1994), of the NADP malat dehydrogenase (Gallardo et al., Planta 197: 324-332, 1995), of the glutathione reductase (Creissen et al., Plant J. 8: 167-175, 1995) or of the R1 protein (Lorberth et al., Nature Biotechnology 16: 473-477, 1998).

Targeting to the mitochondria of plant cells may be accomplished by using the following targeting signal peptides: amino acid residues 1 to 131 of *Arabidopsis thaliana* mitochondrial RNA polymerase (AtRpoT 1) (Plant Journal 17: 557-561, 1999) or the transit peptide described by Braun (EMBO J. 11: 3219-3227, 1992).

Targeting to the vacuole in plant cells may be achieved by using the following targeting signal peptides: The N-terminal sequence (146 amino acids) of the patatin protein (Sonnewald et al., Plant J. 1: 95-106, 1991) or the signal sequences described by Matsuoka and Neuhaus (Journal of Exp. Botany 50: 165-174, 1999); Chrispeels and Raikhel (Cell 68: 613-616, 1992); Matsuoka and Nakamura (PNAS 88: 834-838, 1991); Bednarek and Raikhel (Plant Cell 3: 1195-1206, 1991) or Nakamura and Matsuoka (Plant Phys. 101: 1-5, 1993).

Targeting to the ER in plant cells may be achieved by using, e.g., the ER targeting peptide HKTMLPLPLIPSLLLSLSSAEF (SEQ ID NO: 118) in conjunction with the C-terminal extension HDEL (Haselhoff, PNAS 94: 2122-2127, 1997). Targeting to the nucleus of plant cells may be achieved by using, e.g., the nuclear localization signal (NLS) of the tobacco C2 polypeptide QPSLKRMKIQPSSQP (SEQ ID NO: 119).

Targeting to the extracellular space may be achieved by using e.g. one of the following transit peptides: the signal sequence of the proteinase inhibitor II-gene (Keil et al., Nucleic Acid Res. 14: 5641-5650, 1986; von Schaewen et al., EMBO J. 9: 30-33, 1990), of the levansucrase gene from *Erwinia amylovora* (Geier and Geider, Phys. Mol. Plant Pathol. 42: 387-404, 1993), of a fragment of the patatin gene B33 from *Solanum tuberosum*, which encodes the first 33 amino acids (Rosahl et al., Mol Gen. Genet. 203: 214-220, 1986) or of the one described by Oshima et al. (Nucleic Acids Res. 18: 181, 1990).

Furthermore, targeting to the membrane may be achieved by using the N-terminal signal anchor of the rabbit sucrase-isomaltase (Hegner et al., J. Biol. Chem. 276: 16928-16933, 1992).

Targeting to the membrane in mammalian cells can be accomplished by using the N-terminal myristate attachment sequence MGSSKSK (SEQ ID NO: 120) or C-terminal prenylation sequence CaaX, where "a" is an aliphatic amino acid (i.e. Val, Leu or Ile) and "X" is any amino acid (Garabet, Methods Enzymol. 332: 77-87, 2001).

Additional targeting to the plasma membrane of plant cells may be achieved by fusion to a transporter, preferentially to the sucrose transporter SUT1 (Riesmeier, EMBO J. 11: 4705-4713, 1992). Targeting to different intracellular membranes may be achieved by fusion to membrane proteins present in the specific compartments such as vacuolar water channels (γTIP) (Karlsson, Plant J. 21: 83-90, 2000), MCF proteins in mitochondria (Kuan, Crit. Rev. Biochem. Mol. Biol. 28: 209-233, 1993), triosephosphate translocator in inner envelopes of plastids (Flugge, EMBO J. 8: 39-46, 1989) and photosystems in thylacoids.

Targeting to the golgi apparatus can be accomplished using the C-terminal recognition sequence K(X)KXX (SEQ ID NO: 121) where "X" is any amino acid (Garabet, Methods Enzymol. 332: 77-87, 2001).

Targeting to the peroxisomes can be done using the peroxisomal targeting sequence PTS I or PTS II (Garabet, Methods Enzymol. 332: 77-87, 2001).

Targeting to the nucleus in mammalian cells can be achieved using the SV-40 large T-antigen nuclear localisation sequence PKKKRKV (SEQ ID NO: 122) (Garabet, Methods Enzymol. 332: 77-87, 2001).

Targeting to the mitochondria in mammalian cells can be accomplished using the N-terminal targeting sequence MSVLTPLLLRGLTGSARRLPVPRAKISL (SEQ ID NO: 123) (Garabet, Methods Enzymol. 332: 77-87, 2001).

In some embodiments, expression of the transporter may be targeted to particular tissue(s) or cell type(s). For example, a particular promoter may be used to drive transcription of a nucleic acid encoding the transporter. A promoter is an array of nucleic acid control sequences that direct transcription of a nucleic acid. A promoter includes necessary nucleic acid sequences near the start site of transcription, such as, in the case of a polymerase II type promoter, a TATA element. A promoter also optionally includes distal enhancer or repressor elements, which can be located as much as several thousand base pairs from the start site of transcription. A constitutive promoter is a promoter that is active under most environmental and developmental conditions. An inducible promoter is a promoter that is active under environmental or developmental regulation. Any inducible promoter can be used, see, e.g., Ward et al., Plant Mol. Biol. 22:361-366, 1993. Exemplary inducible promoters include, but are not limited to, that from the ACEI system (responsive to copper) (Meft et al., Proc. Natl. Acad. Sci. USA 90:4567-4571, 1993; 1n2 gene from maize (responsive to benzenesulfonamide herbicide safeners) (Hershey et al., Mol. Gen. Genetics 227:229-237, 1991, and Gatz et al., Mol. Gen. Genetics 243:32-38, 1994) or Tet repressor from Tn10 (Gatz et al., Mol. Gen. Genetics 227:229-237, 1991). The inducible promoter may respond to an agent foreign to the host cell, see, e.g., Schena et al., PNAS 88: 10421-10425, 1991.

The promoter may be a constitutive promoter. A constitutive promoter is operably linked to a gene for expression or is operably linked to a nucleotide sequence encoding a signal sequence which is operably linked to a gene for expression. Many different constitutive promoters can be utilized in the instant invention. For example, in a plant cell, constitutive promoters include, but are not limited to, the promoters from plant viruses such as the 35S promoter from CaMV (Odell et al., Nature 313: 810-812, 1985) and the promoters from such genes as rice actin (McElroy et al., Plant Cell 2: 163-171, 1990); ubiquitin (Christensen et al., Plant Mol. Biol. 12:619-632, 1989, and Christensen et al., Plant Mol. Biol. 18: 675-689, 1992); pEMU (Last et al., Theor. Appl. Genet. 81:581-588, 1991); MAS (Velten et al., EMBO J. 3:2723-2730, 1984) and maize H3 histone (Lepetit et al., Mol. Gen. Genetics 231: 276-285, 1992 and Atanassova et al., Plant Journal 2(3): 291-300, 1992). Prokaryotic promoter elements include those which carry optimal –35 and –10 (Pribnow box) sequences for transcription by RNA polymerase in *Escherichia coli*. Some prokaryotic promoter elements may contain overlapping binding sites for regulatory repressors (e.g. the Lac, and TAC promoters, which contain overlapping binding sites for lac repressor thereby conferring inducibility by the substrate homolog IPTG). Examples of prokaryotic genes from which suitable promoter sequences may be obtained include *E. coli* lac, ara, and trp. Prokaryotic viral promoter elements of the present invention include lambda phage promoters (e.g. $P_{RM}$ and $P_R$), T7 phage promoter elements, and SP6 promoter elements. Eukaryotic promoter vector elements of the invention include both yeast (e.g. GAL1, GAL10, CYC1) and mammalian (e.g. promoters of globin genes and interferon genes). Further eukaryotic promoter vector elements include viral gene promoters such as those of the SV40 promoter, the CMV promoter, herpes simplex thymidine kinase promoter, as well as any of various retroviral LTR promoter elements (e.g. the MMTV LTR (SEQ ID NO: 124)). Other eukaryote examples include the the hMTIIa promoters (e.g. U.S. Pat. No. 5,457,034), the HSV-1 4/5 promoter (e.g. U.S. Pat. No. 5,501,979), and the early intermediate HCMV promoter (WO 92/17581).

The promoter may be a tissue-specific or tissue-preferred promoters. A tissue specific promoter assists to produce the transporter exclusively, or preferentially, in a specific tissue. Any tissue-specific or tissue-preferred promoter can be utilized. In plant cells, for example but not by way of limitation, tissue-specific or tissue-preferred promoters include, a root-preferred promoter such as that from the phaseolin gene (Murai et al., Science 23: 476-482, 1983, and Sengupta-Gopalan et al., PNAS 82: 3320-3324, 1985); a leaf-specific and light-induced promoter such as that from cab or rubisco (Simpson et al., EMBO J. 4(11): 2723-2729, 1985, and Timko et al., Nature 318: 579-582, 1985); an anther-specific promoter such as that from LAT52 (Twell et al., Mol. Gen. Genetics 217: 240-245, 1989); a pollen-specific promoter such as that from Zm13 (Guerrero et al., Mol. Gen. Genetics 244: 161-168, 1993) or a microspore-preferred promoter such as that from apg (Twell et al., Sex. Plant Reprod. 6: 217-224, 1993).

Furthermore, the present invention relates to expression cassettes comprising the above-described nucleic acid molecule of the invention and operably linked to control sequences allowing expression in prokaryotic or eukaryotic cells.

In a further embodiment, the invention relates to a method for producing cells capable of expressing the transporters of the invention comprising genetically engineering cells with an above-described nucleic acid molecule, expression cassette or vector of the invention.

Another embodiment of the invention relates to host cells, in particular prokaryotic or eukaryotic cells, genetically engineered with an above-described nucleic acid molecule, expression cassette or vector of the invention, and to cells descended from such transformed cells and containing a nucleic acid molecule, expression cassette or vector of the invention and to cells obtainable by the above-mentioned method for producing the same.

The host cells may be bacterial, fungal, insect, plant or animal host cells. In one embodiment, the host cell is genetically engineered in such a way that it contains the introduced nucleic acid molecule stably integrated into the genome. In another embodiment, the nucleic acid molecule can be expressed so as to lead to the production of the fusion protein of the invention.

An overview of different expression systems is for instance contained in Methods in Enzymology 153: 385-516, 1987, in Bitter et al. (Methods in Enzymology 153: 516-544, 1987) and in Sawers et al. (Applied Microbiology and Biotechnology 46: 1-9, 1996), Billman-Jacobe (Current Opinion in Biotechnology 7: 500-4, 1996), Hockney (Trends in Biotechnology 12: 456-463, 1994), and Griffiths et al., (Methods in Molecular Biology 75: 427-440, 1997). An overview of yeast expression systems is for instance given by Hensing et al. (Antoine von Leuwenhoek 67: 261-279, 1995), Bussineau (Developments in Biological Standardization 83: 13-19, 1994), Gellissen et al. (Antoine van Leuwenhoek 62: 79-93, 1992), Fleer (Current Opinion in Biotechnology 3: 486-496, 1992), Vedvick (Current Opinion in Biotechnology 2: 742-745, 1991) and Buckholz (Bio/Technology 9: 1067-1072, 1991).

Expression vectors have been widely described in the literature. As a rule, they contain not only a selection marker gene and a replication origin ensuring replication in the host selected, but also a bacterial or viral promoter and, in most cases, a termination signal for transcription. Between the promoter and the termination signal, there is in general at least one restriction site or a polylinker which enables the insertion of a coding nucleotide sequence. It is possible to use promoters ensuring constitutive expression of the gene and inducible promoters which permit a deliberate control of the expression of the gene. Bacterial and viral promoter sequences possessing these properties are described in detail in the literature. Regulatory sequences for the expression in microorganisms (for instance *E. coli, S. cerevisiae*) are sufficiently described in the literature. Promoters permitting a particularly high expression of a downstream sequence are for instance the T7 promoter (Studier et al., Methods in Enzymology 185: 60-89, 1990), lacUV5, trp, trp-lacUV5 (DeBoer et al., in Rodriguez and Chamberlin (Eds), Promoters, Structure and Function; Praeger, N.Y., 1982, p. 462-481; DeBoer et al., PNAS 80: 21-25, 1983), lp1, rac (Boros et al., Gene 42: 97-100, 1986). Inducible promoters may be used for the synthesis of proteins. These promoters often lead to higher protein yields than do constitutive promoters. In order to obtain an optimum amount of protein, a two-stage process is often used. First, the host cells are cultured under optimum conditions up to a relatively high cell density. In the second step, transcription is induced depending on the type of promoter used. In this regard, a tac promoter is particularly suitable which can be induced by lactose or IPTG (isopropyl-.beta.-D-thiogalactopyranoside) (DeBoer et al., PNAS 80: 21-25, 1983). Termination signals for transcription such as the SV40-poly-A site or the tk-poly-A site useful for applications in mammalian cells are also described in the literature. Suitable expression vectors are known in the art such as Okayama-Berg cDNA expression vector pcDV1 (Pharmacia), pCDM8, pRc/CMV, pcDNA1, pcDNA3 (In-vitrogene), pSPORT1 (GIBCO BRL)) or pCI (Promega).

The invention also includes host cells transfected with a vector or an expression vector encoding the transporters of the invention, including prokaryotic cells, such as *E. coli* or other bacteria, or eukaryotic cells, such as yeast cells or animal cells. The living cell cultures may comprise prokaryotic cells or eukaryotic cells. Examples of sources for prokaryotic cells include but are not limited to bacteria or archaea. Examples of sources for eukaryotic cells include but are not limited to: yeast, fungi, protists, mammals, arthropods, humans, animals, molluscs, annelids, nematodes, crustaceans, platyhelminthes, monotremes, fish, marsupials, reptiles, amphibians, birds, rodents, insects, and plants.

The transformation of the host cell with a nucleic acid molecule or vector according to the invention can be carried out by standard methods, as for instance described in Sambrook and Russell, Molecular Cloning: A Laboratory Manual, CSH Press, 2001; Methods in Yeast Genetics, A Laboratory Course Manual, Cold Spring Harbor Laboratory Press, 1990). For example, calcium chloride transfection is commonly utilized for prokaryotic cells, whereas, e.g., calcium phosphate or DEAE-Dextran mediated transfection or electroporation may be used for other cellular hosts. The host cell is cultured in nutrient media meeting the requirements of the particular host cell used, in particular in respect of the pH value, temperature, salt concentration, aeration, antibiotics, vitamins, trace elements etc. The transporters according to the present invention can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromography and lectin chromatography. A ligand or substrate, such as glucose, for the transporter may by used for affinity purification or a fusion protein of the transporter may be purified by applying an affinity chromatography with a substrate or ligand to which the fused portion binds, such as an affinity tag. Protein refolding steps can be used, as necessary, in completing the configuration of the protein. Finally, high performance liquid chromatography (HPLC) can be employed for final purification steps.

Accordingly, a further embodiment of the invention relates to a method for producing the transporters of the invention comprising culturing the above-described host cells under conditions allowing the expression of said transporters and recovering said transporters from the culture. Depending on whether the expressed protein is localized in the host cells or is secreted from the cell, the protein can be recovered from the cultured cells and/or from the supernatant of the medium.

Alternatively, the transporter may be delivered to the cell using microinjection, particle bombardment, introduction of embedded sensors, or by fusion of a peptide sequence that leads to uptake of the biosensor into cells.

Moreover, the invention relates to transporters which are obtainable by a method for their production as described above.

The transporters of the present invention may, e.g., be a product of chemical synthetic procedures or produced by recombinant techniques from a prokaryotic or eukaryotic host (for example, by bacterial, yeast, higher plant, insect or mammalian cells in culture). Depending upon the host employed in a recombinant production procedure, the expressed transporters may be glycosylated or may be non-glycosylated. The transporters of the invention may also include an initial methionine amino acid residue. The transporters according to the invention may be further modified to contain additional chemical moieties not normally part of the protein. Those derivatized moieties may, e.g., improve the stability, solubility, the biological half life or absorption of the protein. The moieties may also reduce or eliminate any undesirable side effects of the protein and the like. An overview for these moieties can be found, e.g., in Remington's Pharmaceutical Sciences, Mack Publishing Co., Easton, Pa.).

Transgenics

The present invention provides transgenic plants and non-human transgenic organisms, i.e. multicellular organisms, comprising a nucleic acid molecule encoding the transporters of the invention, such as GLUEs, or an expression cassette or vector as described above, stably integrated into its genome, at least in a subset of the cells of that organism, or to parts thereof such as tissues or organs.

The present invention provides transgenic plants or plant tissue comprising transgenic plant cells, i.e. comprising stably integrated into their genome, an above-described nucleic acid molecule, expression cassette or vector of the invention. The present invention also provides transgenic plants, plant cells or plant tissue obtainable by a method for their production as outlined below.

In one embodiment, the present invention provides a method for producing transgenic plants, plant tissue or plant cells comprising the introduction of a nucleic acid molecule, expression cassette or vector of the invention into a plant cell and, optionally, regenerating a transgenic plant or plant tissue therefrom. The transgenic plants expressing the transporter can be of use in affecting the transport of sugars throughout and between the organs of an organism, such as to or from the soil. The transgenic plants expressing transporters of the invention can be of use for investigating metabolic or transport processes of, e.g., organic compounds with a timely and spatial resolution that was not achievable in the prior art.

Methods for the introduction of foreign nucleic acid molecules into plants are well-known in the art. For example, plant transformation may be carried out using Agrobacterium-mediated gene transfer, microinjection, electroporation or biolistic methods as it is, e.g., described in Potrykus and Spangenberg (Eds.), Gene Transfer to Plants. Springer Verlag, Berlin, N.Y., 1995. Therein, and in numerous other prior art references, useful plant transformation vectors, selection methods for transformed cells and tissue as well as regeneration techniques are described which are known to the person skilled in the art and may be applied for the purposes of the present invention.

In another aspect, the invention provides harvestable parts and methods to propagation material of the transgenic plants according to the invention which contain transgenic plant cells as described above. Harvestable parts can be in principle any useful part of a plant, for example, leaves, stems, fruit, seeds, roots etc. Propagation material includes, for example, seeds, fruits, cuttings, seedlings, tubers, rootstocks etc.

In certain aspects, the invention provides a transgenic non-human animal having a phenotype characterized by expression of the nucleic acid sequence coding for the expression of the transporters. The phenotype is conferred by a transgene contained in the somatic and germ cells of the animal, which may be produced by (a) introducing a transgene into a zygote of an animal, the transgene comprising a DNA construct encoding the transporters; (b) transplanting the zygote into a pseudopregnant animal; (c) allowing the zygote to develop to term; and (d) identifying at least one transgenic offspring containing the transgene. The step of introducing the transgene into the embryo may include introducing an embryonic stem cell containing the transgene into the embryo, or infecting the embryo with a retrovirus containing the transgene. Preferred transgenic animals will express the encoded transporters. Transgenic animals of the invention include transgenic *S. cerevisae, C. elegans, Drosophila*, particularly, *D. melanogaster*, and transgenic mice and other animals.

The invention also provides a transgenic non-human animal comprising at least one nucleic acid molecule encoding a transporter, expression cassette or vector comprising the nuceliec acid which may be stably integrated into their genome.

The present invention also encompasses a method for the production of a transgenic non-human animal comprising introducing a nucleic acid molecule, expression cassette or vector of the invention into a germ cell, an embryonic cell, stem cell or an egg or a cell derived therefrom. It is preferred that such transgenic animals expressing the transporter of the invention or any developmental stage thereof starting from the zygote may be used as model organisms where it is possible to determine the distribution of a certain compound (depending on the enzyme present in the fusion protein) in real time without disrupting tissue integrity. These model organisms may be particularly useful for nutritional or pharmacological studies or drug screening. Production of transgenic embryos and screening of them can be performed, e.g., as described by A. L. Joyner (Ed.), Gene Targeting, A Practical Approach, Oxford University Press, 1993. The DNA of the embryos can be analyzed using, e.g., Southern blots with an appropriate probe or based on PCR techniques.

A transgenic non-human animal in accordance with the invention may, e.g., be a transgenic mouse, rat, hamster, marsupial, monotreme, dog, monkey, rabbit, chiroptera, pig, frog, nematode such as *Caenorhabditis elegans*, fruitfly such as *Drosophila melanogaster*, or fish such torpediniforms, such as torpedo fish, tetraodontiforms, characiforms, lamniforms, or cypriniforms, such as zebrafish, comprising a nucleic acid molecule, expression cassette or vector of the invention, preferably stably integrated into its genome, or obtained by the method mentioned above. Such a transgenic non-human animal may comprise one or several copies of the same or different nucleic acid molecules of the invention. The presence of a nucleic acid molecule, expression cassette or vector of the invention in such a transgenic non-human animal leads to the expression of the transporter of the invention. The transgenic non-human animal of the invention has numerous utilities, including as a research model. Accordingly, in this instance, the mammal is preferably a laboratory animal such as a chimpanzee, mouse, or rat.

Thus, in one embodiment, the transgenic non-human animal of the invention is a mouse, a rat, a dog, such as a beagle, or a zebrafish. Numerous reports revealed that said animals are particularly well suited as model organisms for the investigation of the drug metabolism and its deficiencies or cancer. Advantageously, transgenic animals can be easily created using said model organisms, due to the availability of various suitable techniques well known in the art for investigating sugar transport, particularly glucose transport.

Antibodies

Another aspect of the invention is directed to the generation of antibodies that bind to the transporters of the invention. Examples of antibodies encompassed by the present invention, include, but are not limited to, antibodies specific for the transporters of the claimed invention and neutralizing antibodies. The antibodies of the invention may be characterized using methods well known in the art.

The antibodies useful in the present invention can encompass monoclonal antibodies, polyclonal antibodies, antibody fragments (e.g., Fab, Fab', F(ab')2, Fv, Fc, etc.), chimeric antibodies, bispecific antibodies, heteroconjugate antibodies, single chain (ScFv), mutants thereof, fusion proteins comprising an antibody portion, humanized antibodies, and any other modified configuration of the immunoglobulin molecule that comprises an antigen recognition site of the required specificity, including glycosylation variants of antibodies, amino acid sequence variants of antibodies, and covalently modified antibodies. Antibodies may be derived from murine, rat, human, primate, or any other origin (including chimeric and humanized antibodies).

In one embodiment, the antibodies may be polyclonal or monoclonal antibodies. Methods of preparing monoclonal and polyclonal antibodies are well known in the art.

The term "monoclonal antibody" as used herein refers to an antibody obtained from a population of substantially homogeneous antibodies, i.e., the individual antibodies comprising the population are identical except for possible naturally occurring mutations that may be present in minor amounts and includes antibody fragments as defined herein. Monoclonal antibodies are highly specific, being directed against a single antigenic site. Furthermore, in contrast to polyclonal antibody preparations which include different antibodies directed against different determinants (epitopes), each monoclonal antibody is directed against a single determinant on the antigen. In addition to their specificity, the monoclonal antibodies are advantageous in that they may be synthesized uncontaminated by other antibodies. The modifier "monoclonal" is not to be construed as requiring production of the antibody by any particular method. For example, the monoclonal antibodies useful in the present invention may be prepared by the hybridoma methodology first described by Kohler et al. (1975) Nature 256, 495 or may be made using recombinant DNA methods in bacterial, eukaryotic animal or plant cells (see U.S. Pat. No. 4,816, 567). The "monoclonal antibodies" may also be isolated from phage antibody libraries using the techniques described in Clackson et al. (1991) Nature 352:624-628 and Marks et al. (1991) J. Mol. Biol. 222, 581-597, for example. "Polyclonal" antibodies refer to a selection of antibodies directed against a particular protein or fragment thereof, wherein the antibodies may bind to different epitopes.

In other embodiments, the antibodies may be humanized by methods known in the art. A humanized antibody is an immunoglobulin molecule that contains minimal sequence derived from non-human immunoglobulin. In yet other embodiments, fully human antibodies are obtained by using commercially available mice that have been engineered to express specific human immunoglobulin proteins. In other embodiments, the antibodies are chimeric. A chimeric antibody is an antibody that combines characteristics from two different antibodies. Methods of preparing chimeric antibodies are known in the art.

In other embodiments, the nucleotide sequence that encodes the antibody is obtained and then cloned into a vector for expression or propagation. In another embodiment, antibodies are made recombinantly and expressed using methods known in the art. By way of example, transporters or fragments thereof may be used as an antigen for the purposes of isolating recombinant antibodies by these techniques. Antigenic motifs of the transporters can readily be determined by methods known in the art, such as for example the Jameson-Wolf method (CABIOS, 4: 181-186, 1988). Antibodies can be made recombinantly by using the gene sequence to express the antibody recombinantly in host cells. Methods for making derivatives of antibodies and recombinant antibodies are known in the art.

In other embodiments, the antibodies are bound to a carrier by conventional methods in the art, for use in, for example, isolating or purifying native transporters or detecting native transporters in a biological sample or specimen.

The term "antibodies or fragments thereof" as used herein refers to antibodies or fragments thereof that specifically bind to a sugar transporter or a fragment thereof and do not specifically bind to other non-transporters. Antibodies or fragments that immunospecifically bind to a transporter or fragment thereof do not non-specifically cross-react with other antigens (e.g., binding cannot be competed away with a non-transporter, e.g., BSA in an appropriate immunoassay). Antibodies or fragments that immunospecifically bind to a transporter can be identified, for example, by immunoassays or other techniques known to those of skill in the art. Antibodies of the invention include, but are not limited to, synthetic antibodies, monoclonal antibodies, heavy-chain only antibodies, recombinantly produced antibodies, intrabodies, diabodies, multispecific antibodies (including bi-specific: antibodies), human antibodies, humanized antibodies, chimeric antibodies, single-chain Fvs (scFv) (including bi-specific scfvs), single chain antibodies, Fab' fragments, F(ab')2 fragments, disulfide-linked Fvs (sdFv), and anti-idiotypic (anti-Id) antibodies, and epitope-binding fragments of any of the above. In particular, antibodies of the present invention include immunoglobulin molecules and immunologically active portions of immunoglobulin molecules, i.e., molecules that contain an antigen binding site that immunospecifically binds to a transporter (e.g., one or more complementarity determining regions (CDRs) of an anti-transporter antibody).

As used herein, an "intact" antibody is one which comprises an antigen-binding site as well as a $C_L$ and at least heavy chain constant domains, $C_{H1}$ and $C_{H2}$ and $C_{H3}$. The constant domains may be native sequence constant domains (e.g., human native sequence constant domains) or amino acid sequence variant thereof. Preferably, the intact antibody has one or more effector functions.

An "antibody fragment" comprises a portion of an intact antibody, preferably the antigen binding CDR or variable region of the intact antibody. Examples of antibody fragments include Fab, Fv, Fab' and F(ab')$_2$ fragments; diabodies; linear antibodies (see U.S. Pat. No. 5,641,870 and Zapata et al. (1995) Protein Eng. 8, 1057-1062); single-chain antibody molecules; and multispecific antibodies formed from antibody fragments.

Papain digestion of antibodies produces two identical antigen-binding fragments, called "Fab" fragments, and a residual "Fc" fragment, a designation reflecting the ability to crystallize readily. The Fab fragment consists of an entire L chain along with the variable region domain of the H chain ($V_H$), and the first constant domain of one heavy chain ($C_{H1}$). Each Fab fragment is monovalent with respect to antigen binding, i.e., it has a single antigen-binding site. Pepsin treatment of an antibody yields a single large F(ab')$_2$ fragment which roughly corresponds to two disulfide linked Fab fragments having divalent antigen-binding activity and is still capable of cross-linking antigen. Fab' fragments differ from Fab fragments by having additional few residues at the carboxy terminus of the $C_{H1}$ domain including one or more cysteines from the antibody hinge region. Fab'-$S_H$ is the designation herein for Fab' in which the cysteine residue(s) of the constant domains bear a free thiol group. $F(ab')_2$ antibody fragments originally were produced as pairs of Fab' fragments which have hinge cysteines between them. Other chemical couplings of antibody fragments are also known.

The Fc fragment comprises the carboxy-terminal portions of both H chains held together by disulfides. The effector functions of antibodies are determined by sequences in the Fc region, which region is also the part recognized by Fc receptors (FcR) found on certain types of cells.

As used herein, "Fv" is the minimum antibody fragment which contains a complete antigen-recognition and -binding site. This fragment consists of a dimer of one heavy- and one light-chain variable region domain in tight, non-covalent association. From the folding of these two domains emanate six hypervariable loops (three loops each from the H and L chain) that contribute the amino acid residues for antigen binding and confer antigen binding specificity to the antibody. However, even a single variable domain (or half of an Fv comprising only three CDRs specific for an antigen) has the ability to recognize and bind antigen, although at a lower affinity than the entire binding site.

As used herein, "Single-chain Fv" also abbreviated as "sFv" or "scFv" are antibody fragments that comprise the VH and VL antibody domains connected into a single polypeptide chain. The scFv polypeptide may further comprises a polypeptide linker between the $V_H$ and $V_L$ domains which enables the sFv to form the desired structure for antigen binding (see Rosenburg et al. (1994) The Pharmacology of Monoclonal Antibodies, Springer-Verlag, pp. 269-315).

As used herein, the term "diabodies" refers to small antibody fragments prepared by constructing sFv fragments (see preceding paragraph) with short linkers (about 5 to about 10 residues) between the $V_H$ and $V_L$ domains such that inter-chain but not intra-chain pairing of the V domains is achieved, resulting in a bivalent fragment, i.e., fragment having two antigen-binding sites. Bispecific diabodies are heterodimers of two "crossover" sFv fragments in which the $V_H$ and $V_L$ domains of the two antibodies are present on different polypeptide chains. Diabodies are described more fully in, for example, WO 93/11161 and Hollinger et al. (1993) Proc. Natl. Acad. Sci. USA 90, 6444-6448.

An "isolated antibody" is one which has been identified and separated and/or recovered from a component of its natural environment. Contaminant components of its natural environment are materials which would interfere with diagnostic or therapeutic uses for the antibody, and may include enzymes, hormones, and other proteinaceous or non-proteinaceous components. In preferred embodiments, the antibody will be purified to greater than 95% by weight of antibody, and most preferably more than 99% by weight. Isolated antibody includes the antibody in situ within recombinant cells since at least one component of the antibody's natural environment will not be present. Ordinarily, however, isolated antibody will be prepared by at least one purification step.

In one embodiment of the invention, the conjugated antibody binds to an epitope on the cytoplasmic domain of a protein specific to cancer cells (i.e., a cancer cell marker). In another embodiment, the conjugated antibody includes, but is not limited to, an antibody which binds to an epitope on the cytoplasmic domain of sF.

Pharmaceutical Compositions

Another aspect of the invention is directed toward the use of the transporters as part of a pharmaceutical composition. The antibodies and nucleic acids of the present invention may also be used as part of a pharmaceutical composition. The compositions used in the methods of the invention generally comprise, by way of example and not limitation, and effective amount of a nucleic acid or polypeptide (e.g., an amount sufficient to induce an immune response) of the invention or antibody of the invention (e.g., an amount of a neutralizing antibody sufficient to mitigate infection, alleviate a symptom of infection and/or prevent infection). The nucleic acids, polypeptides, and antibodies of the invention can further comprise pharmaceutically acceptable carriers, excipients, or stabilizers known in the art (see generally Remington, (2005) The Science and Practice of Pharmacy, Lippincott, Williams and Wilkins).

The nucleic acids, polypeptides, and antibodies of the present invention may be in the form of lyophilized formulations or aqueous solutions. Acceptable carriers, excipients, or stabilizers may be nontoxic to recipients at the dosages and concentrations that are administered. Carriers, excipients or stabilizers may further comprise buffers. Examples of buffers include, but are not limited to, carbohydrates (such as monosaccharide and disaccharide), sugars (such as sucrose, mannitol, and sorbitol), phosphate, citrate, antioxidants (such as ascorbic acid and methionine), preservatives (such as phenol, butanol, benzanol; alkyl parabens, catechol, octadecyldimethylbenzyl ammonium chloride, hexamethoniuni chloride, resorcinol, cyclohexanol, 3-pentanol, benzalkonium chloride, benzethonium chloride, and m-cresol), low molecular weight polypeptides, proteins (such as serum albumin or immunoglobulins), hydrophilic polymers amino acids, chelating agents (such as EDTA), salt-forming counter-ions, metal complexes (such as Zn-protein complexes), and non-ionic surfactants (such as TWEEN™ and polyethylene glycol).

The pharmaceutical composition of the present invention can further comprise additional agents that serve to enhance and/or complement the desired effect. By way of example, to enhance the immunogenicity of a transporter of the invention, the pharmaceutical composition may further comprise an adjuvant. Adjuvants include aluminum salts (alum), Complete Freund's Adjuvant (CFA), Incomplete Freund's Adjuvant (IFA), Muramyl dipeptide (MDP), synthetic analogues of MDP, N-acetylmuramyl-L-alanyl-D-isoglutamyl-L-alanine-2-[1,2-dipalmitoyl-s-glycero-3-(hydroxyphosphoryloxy)]ethylamide (MTP-PE) and compositions containing a metabolizable oil and an emulsifying agent, wherein the oil and emulsifying agent are present in the form of an oil-in-water emulsion having oil droplets substantially all of which are less than one micron in diameter (see, for example, EP 0399843).

In some embodiments, the adjuvant comprises a Toll like receptor (TLR) 4 ligand, in combination with a saponin. The Toll like receptor (TLR) 4 ligand may be for example, an agonist such as a lipid A derivative particularly monophosphoryl lipid A or more particularly 3 Deacylated monophoshoryl lipid A (3 D-MPL). 3 D-MPL is sold under the trademark MPL® by Corixa Corporation and primarily promotes CD4+ T cell responses with an IFN-g (Th1) phenotype. It can be produced according to the methods disclosed in GB 2220211A. Chemically, it is a mixture of 3-deacylated monophosphoryl lipid A with 3, 4, 5 or 6 acylated chains. In one embodiment in the compositions of the present invention small particle 3 D-MPL is used. Small particle 3 D-MPL has a particle size such that it may be sterile-filtered through a 0.22 μm filter. Such preparations are described in PCT Patent Application WO 94/21292.

The adjuvant may also comprise one or more synthetic derivatives of lipid A which are known to be TLR 4 agonists including, but not limited to: OM174 (2-deoxy-6-o-[2-deoxy-2-[(R)-3-dodecanoyloxytetra-decanoylamino]-4-o-phosphono-β-D-glucopyranosyl]-2-[(R)-3-hydroxytetradecanoylamino]-α-D-glucopyranosyldihydrogenphosphate), as described in PCT Patent Application WO 95/14026; OM 294 DP (3S,9R)-3-[(R)-dodecanoyloxytetradecanoylamino]-4-oxo-5-aza-9(R)-[(R)-3-hydroxytetradecanoylamino]decan-1,10-diol,1,10-bis(dihydrogenophosphate), as described in WO 9964301 and WO 00/0462; and, OM 197 MP-Ac DP (3S-,9R)-3-[(R)-dodecanoyloxytetradecanoylamino]-4-oxo-5-aza-9-[(R)-3-hydroxytetradecanoylamino]decan-1,10-diol,1-dihydrogenophosphate 10-(6-aminohexanoate) (WO 01/46127).

Other TLR4 ligands which may be used include, but are not limited to, alkyl Glucosaminide phosphates (AGPs) such as those disclosed in WO 98/50399 or U.S. Pat. No. 6,303,347 (processes for preparation of AGPs are also disclosed), or pharmaceutically acceptable salts of AGPs as disclosed in U.S. Pat. No. 6,764,840. Some AGPs are TLR4 agonists, and some are TLR4 antagonists. Both can be used as one or more adjuvants in the compositions of the invention.

A saponin carrier for use in the present invention is Quil A and its derivatives. Quil A is a saponin preparation isolated from the South American tree *Quilaja Saponaria Molina* and was first described as having adjuvant activity by Dalsgaard et al. (1974) *Saponin adjuvants*, Archiv. für die gesamte Virusforschung, Vol. 44, Springer Verlag, pp. 243-254. Purified fragments of Quil A have been isolated by HPLC which retain adjuvant activity without the toxicity associated with Quil A (EP 0 362 278), for example QS7 and QS21 (also known as QA7 and QA21). QS21 is a natural saponin derived from the bark of *Quillaja saponaria Molina* which induces CD8+ cytotoxic T cells (CTLs), Th1 cells and a predominant IgG2a antibody response and is a preferred saponin in the context of the present invention.

Particular formulations of QS21 have been described which are particularly preferred, these formulations further comprise a sterol (WO 96/33739). The saponins forming part of the present invention may be separate in the form of micelles, mixed micelles (preferentially, but not exclusively with bile salts) or may be in the form of ISCOM matrices (EP 0109942 B1), liposomes or related colloidal structures such as worm-like or ring-like multimeric complexes or lipidic/layered structures and lamellae when formulated with cholesterol and lipid, or in the form of an oil in water emulsion (for example as in WO 95/17210). The saponins may be associated with a metallic salt, such as aluminium hydroxide or aluminium phosphate (WO 98/15287). In some embodiments, the saponin is presented in the form of a liposome, ISCOM or an oil in water emulsion.

In some embodiments, adjuvants are combinations of 3D-MPL and QS21 (EP 0671948 B1) and oil in water emulsions comprising 3D-MPL and QS21 (WO 95/17210, WO 98/56414).

Methods of Using Sugar Transporters

The present invention provides for methods of using the sugar transporters, for example GLUE. The methods comprise introducing the sugar transporters into a cell, such as a cell in vitro or the cell of an organism. The sugar transporter introduced into a cell may be a wild-type or mutant transporter. The transporter may be introduced as a nucleic acid encoding the transporter or as an amino acid polypeptide. The ability of the transporter to function will be apparent to those skilled in the art based on the desired outcome. For example, a constitutively active or a wild-type transporter may be used to overcome a sugar transport deficiency. A mutant transporter may be used to overcome a problem with sugar transport. A variant of a sugar transport may be introduced to alter the desired gene expression of a pathogen.

The methods of the present invention provide for altering the development of an organism. The organism may be an adult or an embryo. Introduction into a cell of the organism may affect the development of the organism. In a plant, the introduction of the sugar transporters may affect leaf development, shoot development, nectar development, root development, anther development, xylem development, reproductive development, stem development, and fruit development. In an animal, the introduction of the sugar transporters of the claimed invention may affect development of an organs, such as the brain heart, lungs, circulatory system, skin, liver, kidney, brain, spine, bones, muscle (smooth and skeletal), limbs, lugs, spleen, intestines, pancreas, adrenal glands, gall bladder, testes, ovaries, prostate, bladder, stomach, thyroid, parathyroid, hypothalamus, hippocampus, pineal gland, lymph nodes, mammary glands, immune system, or ductal systems.

The methods of the present invention may provide for affecting the functioning systems between organs of an organism, such as the circulatory systems, nervous system (both sympathetic and parasympathetic) respiratory system, digestive system, excretory system, and reproductive system. In plants, introduction of the sugar transporters may affect sugar transport between the root and the stem and the leaves. In an animal, introduction of the sugar transporters may affect milk production, development and functioning of the reproductive glands, ovulation, oxygen and carbon dioxide exchange, digestion of food and adsorption of nutrients.

The methods of the present invention provide novel mechanisms for affecting the susceptibility of attack to an organism, such as a pathogen attack. A pathogen may be a prokaryote or eukaryote. A pathogen may be a bacterium, a virus, a fungus, a worm, or an insect. The pathogen may affect gene regulation of a host organism to provide nutrients or sustinance to the pathogen, such as through host susceptible genes. The transporters of the present invention may alter the pathogens ability to affect the host organisms gene transcription. The sugar transporters of the claimed invention introduced into the host cell may defend the host cell from pathogen attack.

Those skilled in the art will appreciate that similar efflux steps are required to supply developing pollen, germinating pollen, developing embryos and all other cases where cells are exchanging carbon through an apoplasmic route (cell to cell via cell wall). A GLUE homolog, RPG1, is localized in the tapetum and a mutation in RPG1 leads to inviability of pollen (Guan Y F, Huang X Y, Zhu J, Gao J F, Zhang H X Yang Z N. 2008 Plant Physiol. 147:852-63). Thus manipulation of the transporters may affect allocation.

The transporters of the present invention may modulate the secretion of sugars, such as glucose, into the rhizosphere of a plant. For example, plants secrete 1.5 t/ha carbon into soil per vegetation period. The methods of the present invention may allow for manipulation of sugar secretion which in turn may affect plant productivity. By way of example, an increase in sugar secretion may attract more microorganisms to the cell, and may deposit more carbon into the soil (e.g. sequester atmospheric $CO_2$). Reduction in sugar secretion may lead to increased biomass in plant. The general concept of such transporters in roots has been described in part in Chaudhuri et al. 2008, Plant Journal.

The transporters of the present invention may modulate the secretion of sugars, such as glucose, into the phyllosphere of a plant. For example, modulation in sugar secretion in the phyllopsphere may attract more beneficial microorganisms or feed pathogens. Manipulation (also through development of specific chemical inhibitors as pesticides)

The transporters of the present invention may modulate the secretion of sugars, such as glucose, to affect the pollination patterns of a plant. The manipulation of sugar secretion may affect pollination patterns. For example, altered sugar secretion may attract different pollinators as different pollinators require different nectar composition (Ge et al. *Plant J.* 24:725-734, 2000).

The transporters of the present invention may modulate the secretion of sugars, such as glucose, and affect the development of the leaf and phloem of a plant. For example, Ge et al. have demonstrated that overexpression of a related protein leads to stimulation of phloem development and alters the symmetry of the leaf. Plant architecture may also be manipulated by the methods described herein.

Another aspect of the invention concerns methods to modulate pathogen activity towards a plant and the cells of the plant. Pathogens (including symbionts) recruit certain transporters to feed them (Yang et al. 2006 PNAS 103: 10503-10508). Yang et al. consider the gene a susceptibility factor, which is induced by a type III secretion-system-dependent mechanism in a pathovar-specific way. By analyzing microarray data it can demonstrated that different pathogens recruit different members of the GLUE family. One means by which pathogens may recruit transporters is to affect the promoter region of the nucleic acid encoding the transporter to increase the number of transporters present in a cell or their activity. Manipulation, such as introducing different transporters or introducing different promoters upstream of the transporter may prevent pathogen infections and improve or transfer symbionts. Chemical inhibitors may be identified that block the transporter and thus prevent pathogen infection. Export of sugars from leaves requires not only a proton sucrose cotransporter for phloem loading, but also cellular effluxers for export from mesophyll or phloem cells. Manipulation can affect plant productivity.

Milk is an important nutrient source for newborns, children and adults. In the US, milk consumption exceeds 80 liters per capita (www.foodsci.uoguelph.ca/dairyedu/intro.html). Milk is also used to produce butter, yoghurt and cheese. In mammals, milk represents the primary source of nutrition for newborns. Mother's milk and cow milk provide many important nutrients as well as antibodies to the newborns. Besides proteins and lipids, milk contains also soluble sugars such as glucose and the disaccharide lactose. The lactose content of human milk is ~7% (200 mM), that of bovine milk ~4.5% (140 mM). Lactose is produced in alveolar cells that line the milk ducts of mammary glands. Specifically, lactose synthesis occurs in the Golgi, mediated by the heteromeric enzyme lactose synthase consisting of an β-1,4-galactosyltransferase subunit and lactalbumin, which is highly induced during lactation.

The precursor glucose is imported through the basal membrane into the glandular cells by glucose transporters belonging to the GLUT and SGLT families. Both glucose and UDP-galactose transporters are required at the Golgi for import of the precursors for lactose synthesis, however the Golgi glucose importer has not been identified. Lactose is assumed to occur by exocytosis (2). Since the membrane of the Golgi vesicles appears to be impermeable to disaccharides, the high osmotic potential attracts water import. During exocytosis, the water will be exported, contributing a major fraction of the water content of the milk. Understanding the cellular machinery contributing to lactose synthesis is thus important for multiple aspects of milk production and composition. Moreover, lactose content in bovine milk represents health issues for large parts of the population due to the inability to efficiently metabolize lactose by lactase in the intestine. Lactase deficiencies can be congenital (rare mutations affecting lactase activity in the intestine), or acquired (secondary lactase deficiency). The most common cause of lactase deficiency is a decrease in the amount of lactase that occurs after childhood and persists into adulthood, referred to as adult-type hypolactasia. Almost 100% of the Asian population suffers from hypolactasia, leading to the necessity to eat lactose-free diets. Thus the present invention may be utilized to alter the production of milk in a subject. The present invention may alter a cell's ability to import or export lactase.

EXAMPLES

Signaling cascades that control nutrient uptake and metabolism as well as the exchange of nutrients in biotic interactions with plants, e.g. nectar production in flowers to attract pollinators, the secretion of sugars by the plant root into the rhizosphere to feed microorganisms and the hijacking of these systems by pathogens. A novel transporter involved in supplying reproductive cells, nectaries, the rhizosphere and pathogens with sugars was recently identified. It was then found that this plant transporter has homologs in animals, specifically in mammals where the protein show many of the features of being involved in sugar secretion in mammary glands. FRET nanosensors provide a unique tool enabling quantitative flux analysis with subcellular resolution (Okumoto et al. *New Phytol.* 180:271-295, 2008). These nanosensors are composed of bacterial periplasmic binding proteins serving as recognition elements, coupled allosterically to a pair of spectral variants of the Green Fluorescent Protein (GFP) as reporter elements (Fehr et al. *Proc. Natl. Acad. Sci. USA* 99:9846-9851, 2002;Fehr et al. *J. Biol. Chem.* 278:19127-19133, 2003; Deuschle et al. *Protein Sci* 14:2304-2314, 2005).

Conformational changes induced by ligand-binding to the recognition element translate into a change in fluorescence resonance energy transfer (FRET) between attached cyan and yellow fluorescent protein moieties. These sensors can be introduced genetically into living cells, permitting non-invasive measurements of analyte levels in living cells and tissues (Fehr et al. *J. Biol. Chem.* 278:19127-19133, 2003). Through these sensors, glucose flux in intact *Arabidopsis* roots (Chaudhuri et al. *Plant J.* 56:948-962, 2008), glutamate release from hippocampal neurons (Okumoto et al. *Proc Natl Acad Sci USA* 102:8740-8745, 2005), and tryptophan exchange in cancer cells (Kaper et al. *PLoS Biol* 5:e257, 2007) has been determined.

Example 1

Analysis of Glucose Flux Across the ER Membrane

To determine analyte levels inside organelles, these FRET nanosensors were targeted to the respective subcellular compartments (Fehr et al. *J. Fluoresc.* 14:603-609, 2004). In order to directly monitor glucose flux across the ER membrane, FRET glucose sensors were targeted to the ER lumen by flanking them with an ER signal sequence and a KDEL retention signal. This approach permitted identification of high glucose flux rates across the ER membrane, and suggested the existence of rapid bidirectional high-capacity transport activities for glucose in HepG2 cells (Fehr et al. *Mol Cell Biol* 25:11102-11112, 2005).

Example 2

Identification of a Novel Sugar Transport Function in Plant Roots

Although soil contains only traces of soluble carbohydrates, plant roots efficiently take up glucose and sucrose when supplied in artificial media. Soluble carbohydrates and other small metabolites found in soil are in part derived from exudation from plant roots. The molecular nature of the transporters for uptake and exudation is unknown. FRET glucose and sucrose sensors were deployed to characterize accumulation and elimination of glucose and sucrose in *Arabidopsis* roots tips (Chaudhuri et al. *Plant J.* 56:948-962, 2008). Glucose and sucrose accumulation was insensitive to protonophores, and was similar at pH 5.8, 6.8 and 7.8, suggesting that both influx and efflux may be mediated by a novel class of proton-independent transport systems. Moreover, as opposed to all known plant glucose transporters, this new root transport system did not mediate transport of the glucose analog 3-O-methylglucose.

Example 3

HEK293T Cells as an Expression System for Glucose Transporters

To be able to characterize glucose transport across the plasma membrane as well as the ER membrane better, cell lines with low endogenous sugar uptake capacity were assayed. It was found that HEK293T cells had very low endogenous uptake and can be used as an expression system to define the properties of GLUT and SGLT sugar transporters with the help of FRET glucose sensors.

Example 4

Figure 3:
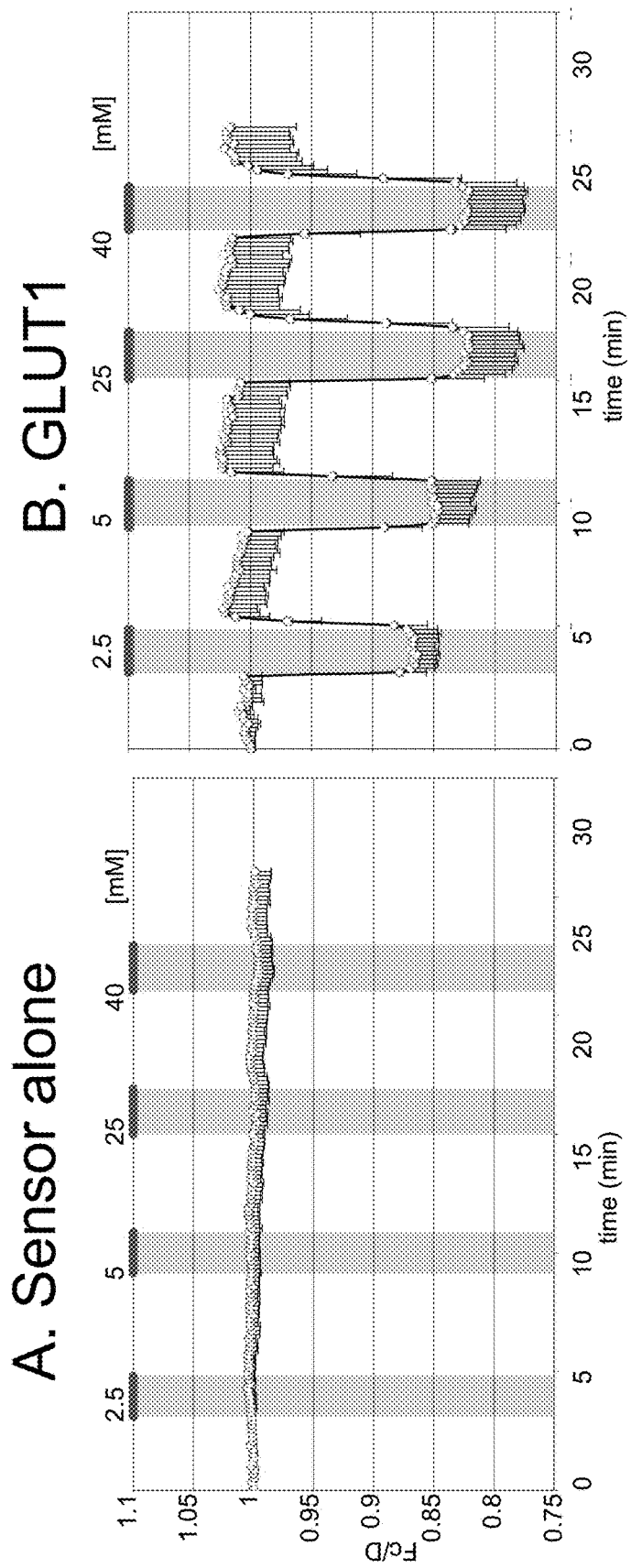
FIGS. 3A and 3B show the response with a glucose FRET sensor expressed in a cell.
Figure 4:
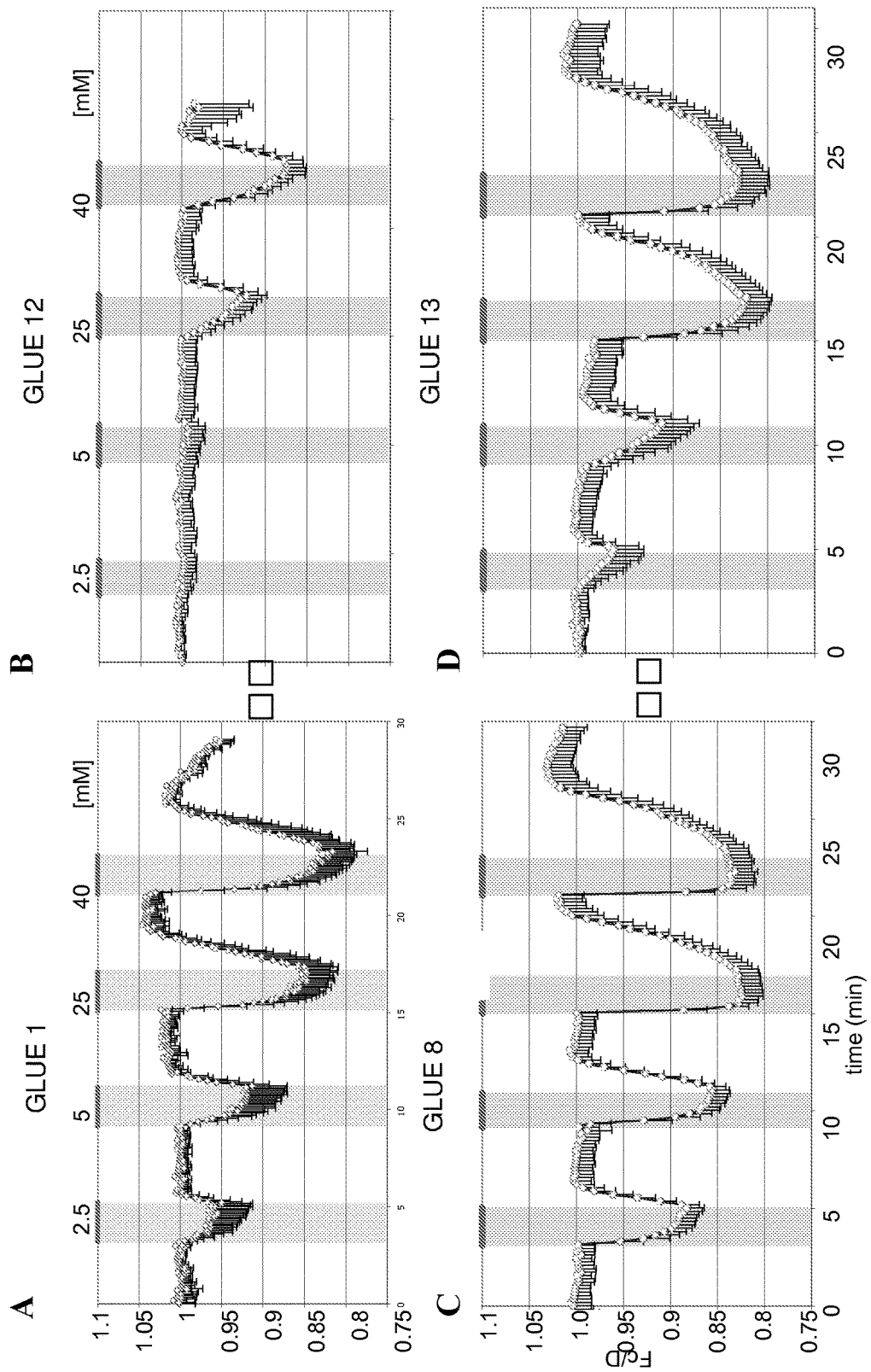
FIGS. 4A-4D show the response of the glucose FRET sensor to altered concentrations of glucose with varying GLUE proteins expressed.
Figure 5:
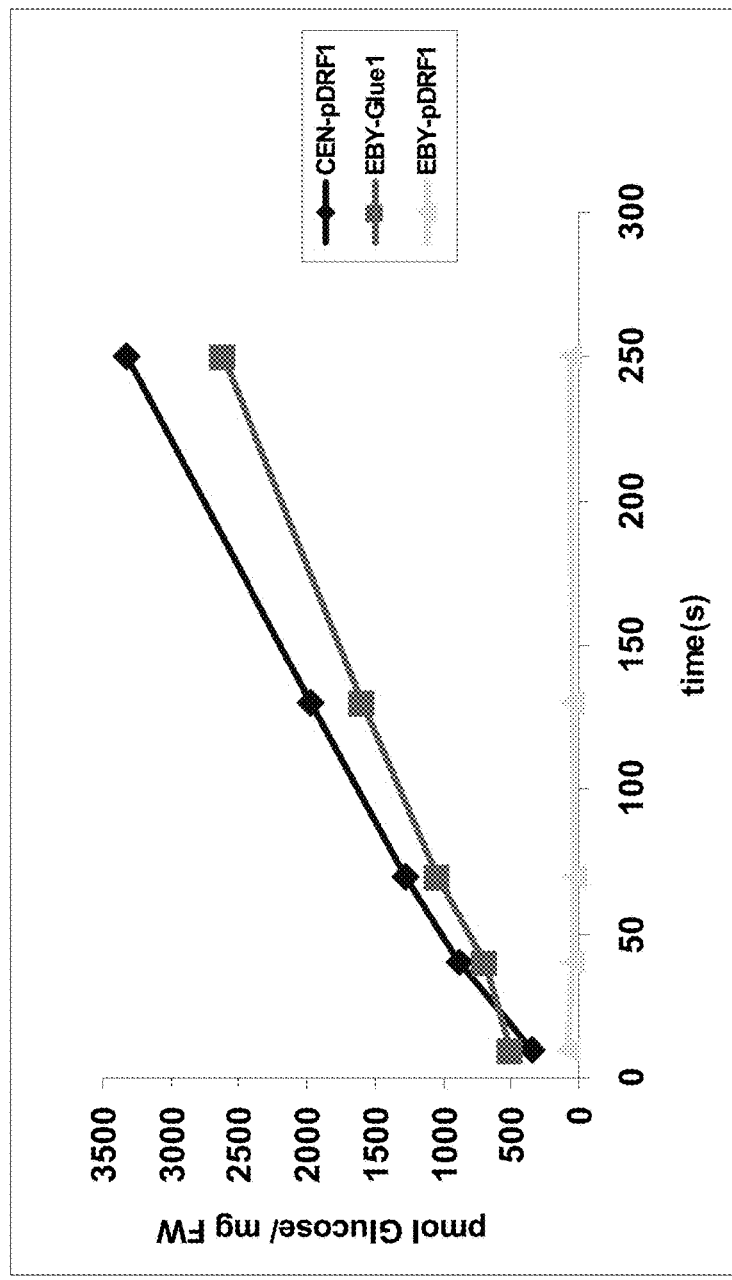
FIG. 5 shows that the glucose uptake-deficient strain EBY4000 with vector only (EBY-pDRF1) can not uptake D-glucose. Radiolabelled 14C-glucose uptake was measured over time. In contrast, GLUE1 enables yeast strain EBY4000 (EBY-GLUE1) to take up glucose. The glucose uptake competent wild type strain CENPK (CEN) serves as a positive control and is able to take up glucose.
Figure 6:
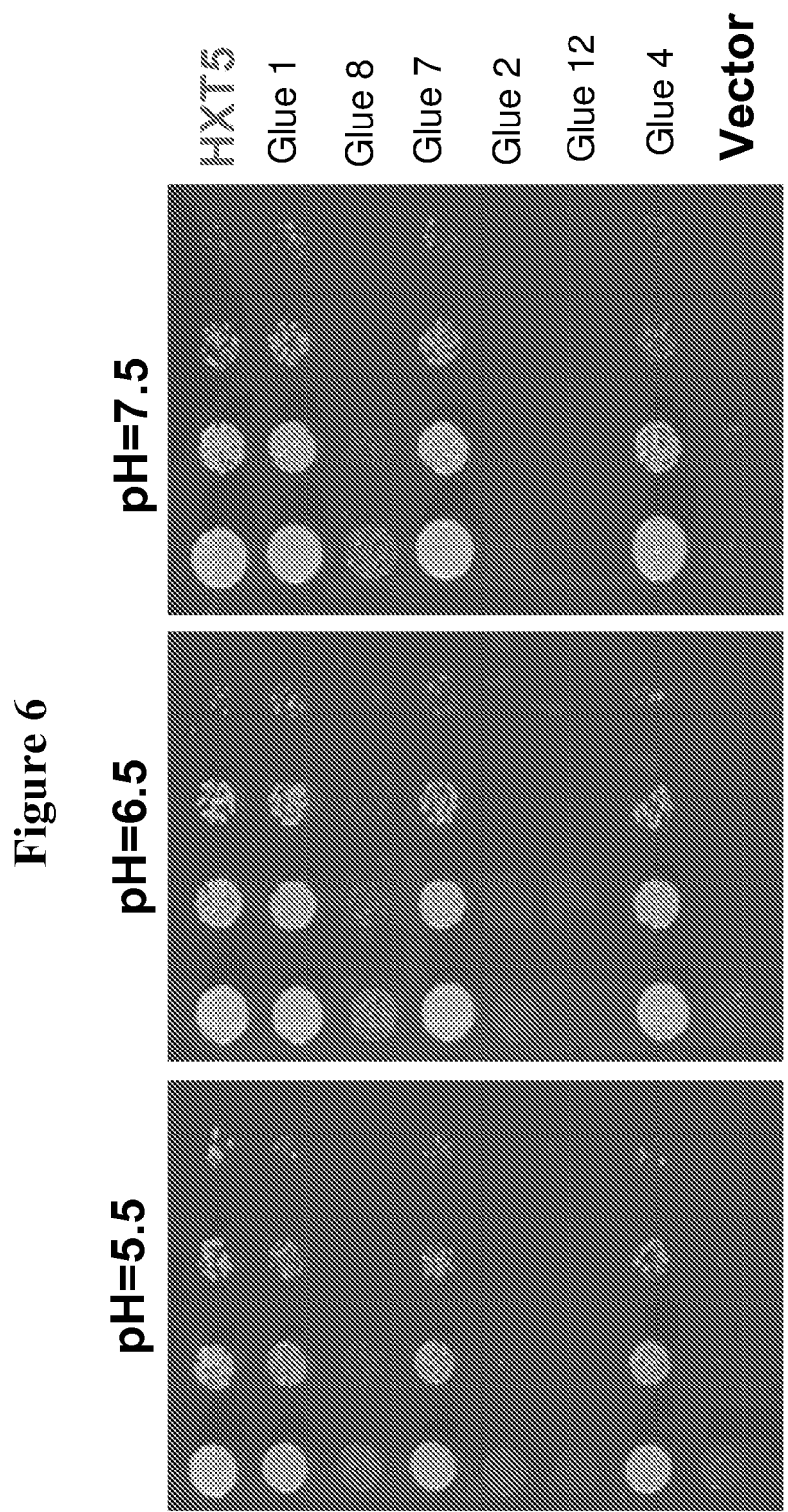
FIG. 6 shows that 4 of 15 genes for GLUEs tested can rescue yeast mutant. Yeast was grown on 2% glucose with different pH.
Figure 7:
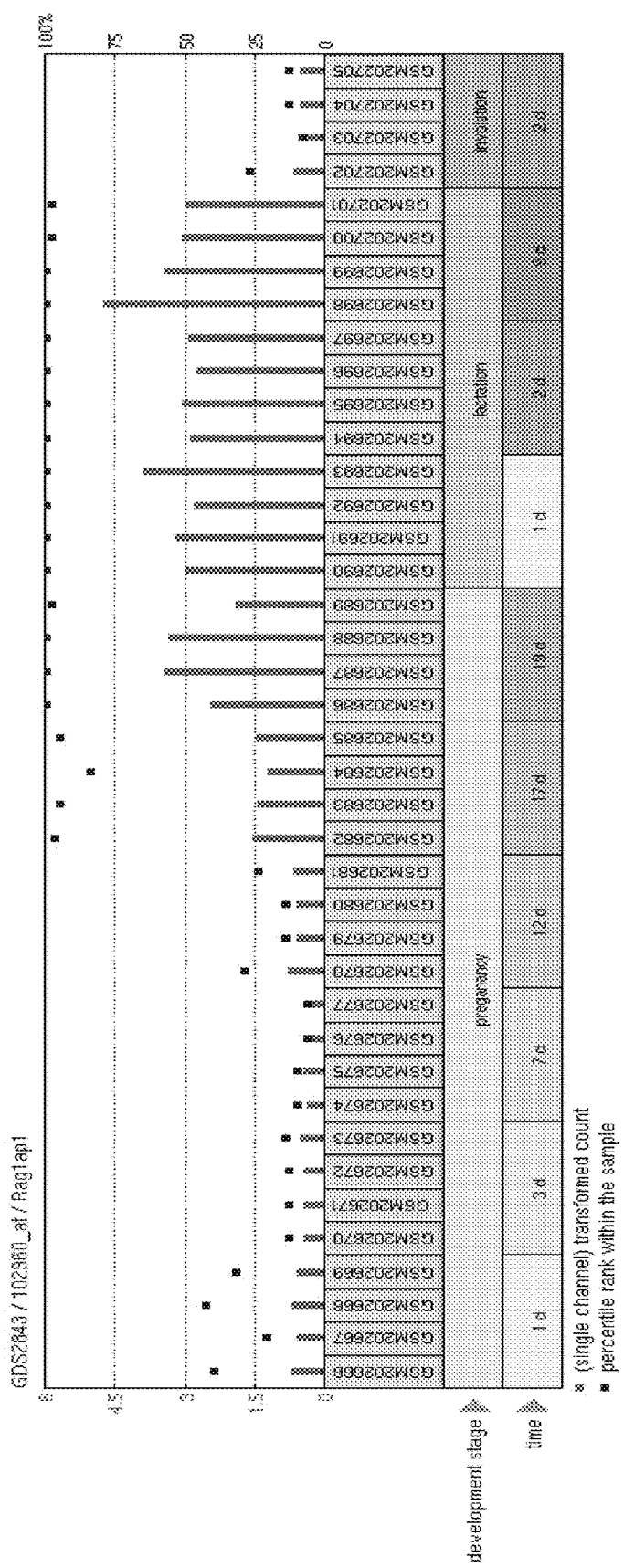
FIG. 7 shows the induction of RAG1AP1 (HsSWEET1) during lactation. Microarray data suggest that the putative sugar transporter RAG1AP1 is upregulated during lactation.
Figure 8:
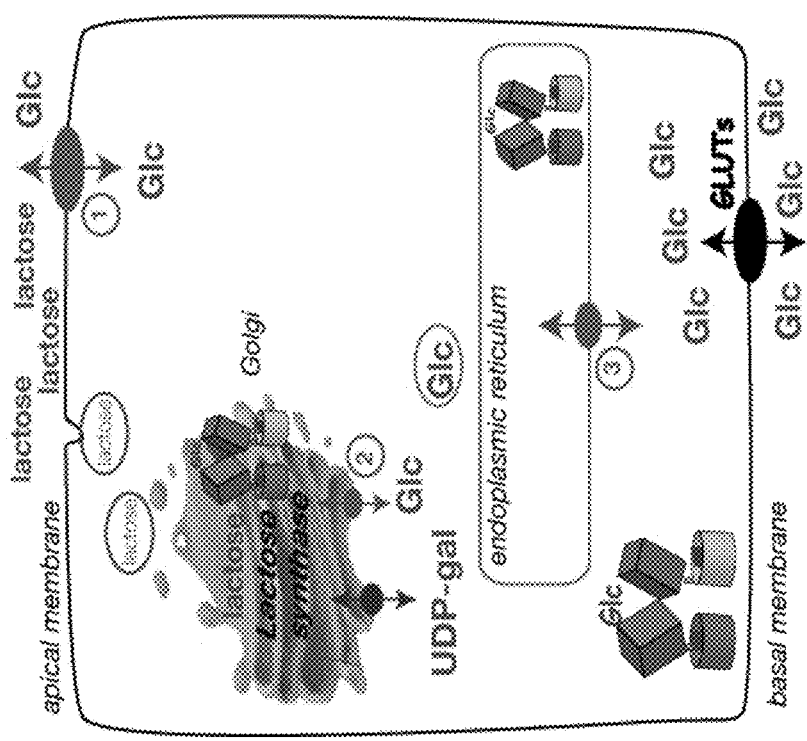
FIG. 8 shows lactose synthesis and secretion from alveolar cells. Glucose is imported through the basal membrane by GLUTs/SGLTs and then imported either into the ER (circle 1) or Golgi (circle 2) by unknown transporters. Lactose synthesis occurs in the Golgi and lactose is assumed to be exocytosed on the apical side that faced the milk duct. An unknown transporter either exports glucose through the apical membrane or is involved in retrieval of glucose from the milk (circle 3).

Identification of a Glucose Transporter Involved in Nectar Production and Rhizosphere Secretion By utilizing the above described HEK293T cell system, a novel class of *Arabidopsis* sugar transporters was identified that are involved in nectar production in plants and with all hallmarks of the glucose transport activity described in root tips. A screening assay was then initiated in which candidate transporter genes from *Arabidopsis* were coexpressed with the FRET glucose sensor in the HEK293T cell expression system. It was found that a member of an unknown class of membrane proteins (named GLUE1) induced glucose concentration-dependent FRET responses (see, e.g., FIGS. 3 and 4).

It was then verified that none of the known mammalian GLUT or SGLT transporter genes was induced when GLUE1 was expressed in the HEK293T cells, and showed that GLUE1-mediated uptake was insensitive to the GLUT inhibitor cytochalasin B. Moreover, results showed that GLUE1 is unable to transport 3-O-methylglucose. Through the use of sensors expressed inside the lumen of the endoplasmic reticulum, it could be demonstrated that GLUEs not only mediate uptake into the cytosol, but can also export glucose out of the cytosol. Similar results were obtained for several *Arabidopsis* paralogs of this gene family.

In order to exclude the possibility that GLUE1 interacts with an endogenous signaling cascade, GLUE1 was expressed in a glucose-uptake-deficient yeast strain EBY4000. Results showed that GLUE1 mediates uptake of glucose with a $K_M$ of 10 mM in an energy-independent manner. GLUE1 encodes a small protein that contains seven transmembrane spanning domains, similar to the water and solute transporting aquaporins. GLUE1-GFP fusions localize to the plasma membrane (see, e.g., FIG. 9).

Taken together, these data show that GLUE1 encodes a novel class of sugar uniporters, with properties identical to the root transport system in *Arabidopsis* roots (Chaudhuri et al. *Plant J.* 56:948-962, 2008). Analysis of microarray data shows that members of the family are indeed expressed in roots.

Members of this protein family are expressed for example in nectaries (Ge et al. *Plant J.* 24:725-734, 2000) and in the tapetum (Guan et al. *Plant Physiol.* 147:852-863, 2008). Given their ability to efflux sugars, GLUEs may be responsible for the secretion of glucose to produce nectar in flowers, that they export glucose from the tapetum to supply developing pollen and secrete glucose into the rhizosphere to attract and feed beneficial microorganisms (Chaudhuri et al. *Plant J.* 56:948-962, 2008).

Example 5

A Human Homolog of the Plant GLUE Transporters

Figure 9:
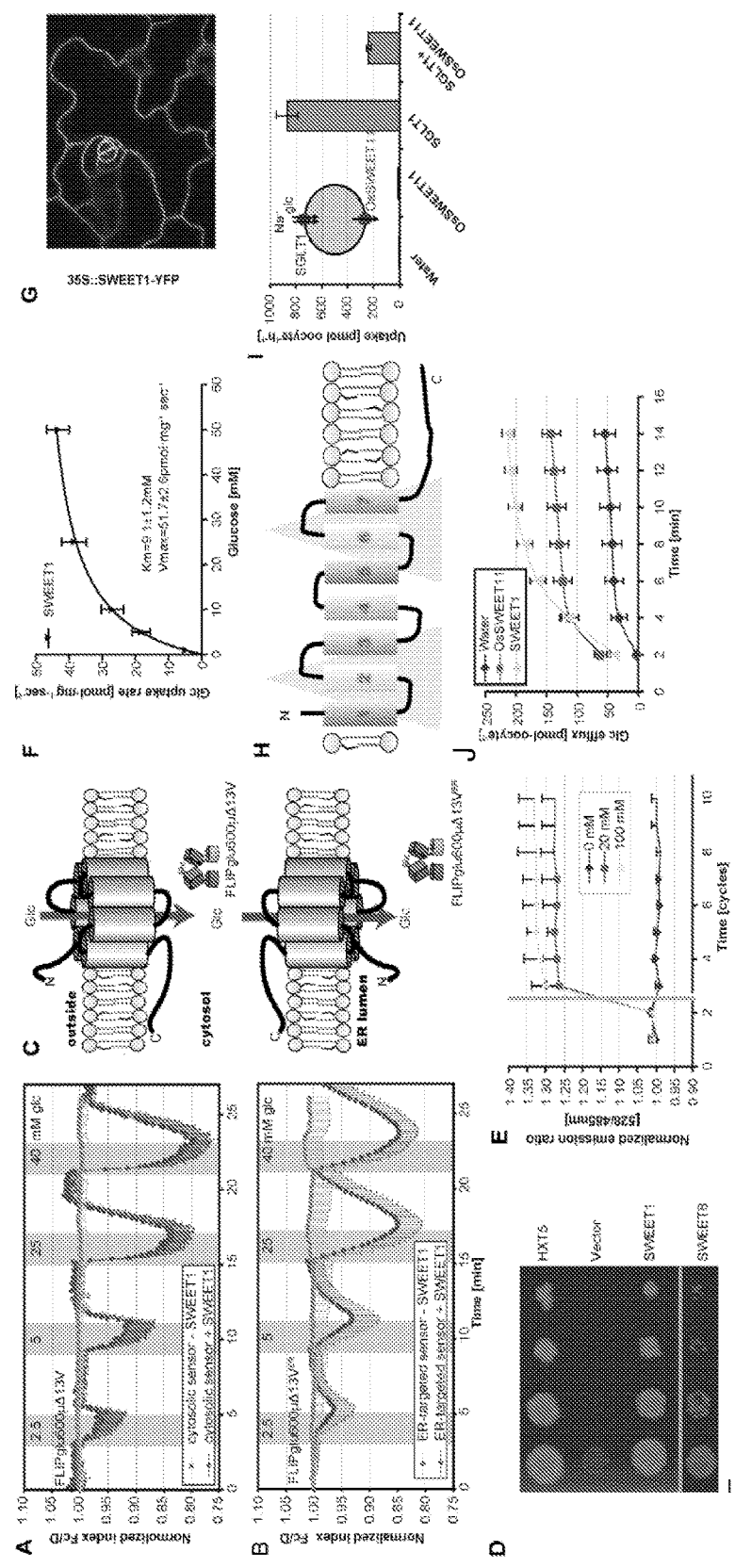
FIG. 9 shows the identification and characterization of SWEET (GLUE) transporters.

Similarity searches identified a GLUE homolog in the mouse and human genome named RAG1AP1 (Tagoh et al. *Biochem Biophys Res Commun* 221:744-749, 1996). RAG1AP1 shares significant homology with the plant GLUEs and also encodes a protein with seven predicted transmembrane spanning domains. In contrast to *Arabidopsis*, the mouse and human genomes each contain only a single member. A mutant lymphocyte cell line lacking RAG1AP1 activity was shown to control the expression of genes involved in antibody maturation (Tagoh et al. *Biochem Biophys Res Commun* 221:744-749, 1996). This may be an indirect effect caused by the inability to secrete glucose or glucose analogs. RAG1AP1 may have an indirect role in controlling the expression of genes involved in antibody variation. Microarray studies demonstrate that this gene is highly induced during lactation (FIG. 9).

Together with the functional evidence that the plant GLUEs are involved in the secretion of glucose in plants, RAG1AP1 may function in a role either in lactose secretion and/or in glucose transport in the alveolar cells of the mammary gland. This is supported by data from a large proteomics program, the Human Protein Atlas, which suggests that RAG1AP1 (RAG1 activating protein 1) is specifically expressed in glandular cells of the breast (www.proteinatlas.org/normal_unit.php?antibody_id=18095&mainannotation_id=1747078). Moreover, the protein appears to localize also to other glandular cells in the human body, e.g. in the epididymis, potentially feeding sperm cells.

Example 6

Plant Sugar Efflux Transporters for Nutrition of Pathogens

Materials and Methods
qPCR and RT-PCR Analysis.

Total RNA was extracted from HepG2 or HEK293T cells using an RNeasy MINI kit (QIAGEN, Hilden), first strand cDNA was produced (New England Biolabs) and fragments of the predicted length were obtained by RT-PCR using a set of GLUT and SGLT primers published previously. Samples were separated on a 2% agarose gel. For samples inoculated by Pst DC3000, total RNA was extracted from the leaves using Trizol reagent (Invitrogen). Real-time quantitative PCR (qPCR) was performed using HotStart-IT SYBR Green qPCR Master Mix (USB) according to the manufacturer's instructions on a 7300 PCR system (Applied Biosystems). Actin (ACT8) expression was used to normalize expression values in each sample; relative expression values were determined relative to the value of the sample infiltrated with 1 mM $MgCl_2$ buffer at each time point using the comparative $2^{-\Delta\Delta Ct}$ method. For samples infected by *G. cichoracearum*, qPCR assays were performed using a Light-Cycler® 480 (Roche). For quantification, relative transcript levels for each gene were normalized to ACT8 following the $2^{-\Delta\Delta Ct}$ method. Fold-change was calculated relative to the untreated sample. Analysis was repeated twice independently. Induction is confirmed by microarray data (Genevestigator).

Constructs.

Cloning of the SGLT1 ORF in pOO2 has been described. SWEET1, SWEET8 and OsSWEET11 ORFs were amplified by RT-PCR using specific primers from *Arabidopsis* and rice, respectively. First strand cDNA from rice was kindly provided by Pamela Ronald, UC Davis. The ORFs were cloned into pDONR221 (Invitrogen) by Gateway BP clonase reactions, and mobilized into the yeast expression vector pDRf1-GW by Gateway LR recombination reactions. SWEET1 was cloned into p112-A1NE-GW for yeast co-transformation with $FLII^{12}Pglu700\mu\Delta6$ in pDRf1-GW. p112-A1NE-GW was generated by inserting a Gateway cassette into the SmaI restriction site of p112-A1NE. For radiotracer experiments, ORFs with stop codons for SWEET1, SWEET8 and OsSWEET11 were cloned into the oocytes expression vector pOO2-GW (D. Logué, unpublished results) by Gateway LR recombination reactions.

FRET Analysis.

Cell culture, transfection, image acquisition and FRET analysis were performed as described previously.

A modified version of the yeast strain EBY4000 (hxt1 through −17Δ::loxP gal2Δ::loxP stl1Δ::loxP agt1Δ::loxP ydl247wΔ::loxP yjr160cΔ::loxP) carrying a cytosolic invertase (YSL2-1) was transformed with SWEETs and HXT5 and grown on SD (synthetic deficient) medium supplemented with 2% maltose and required auxotrophic markers. For complementation growth assays, cells were grown overnight in liquid minimum medium to $OD_{600}$~0.6 and then diluted to $OD_{600}$~0.2 using water. Serial dilutions (1×, 5×, 25×, and 125×) were plated on SD media containing either 2% maltose (as control) or 2% glucose and the relevant auxotrophic markers. Growth was documented by scanning (CanoScan, Canon) the plates after 2-5 days at 30° C.

Yeast uptake. Yeast cells were grown in SD medium supplemented 2% maltose and auxotrophic markers. Cells were harvested at $OD_{600}$ 0.5-0.7 by centrifugation, and washed twice in ice-cold distilled water. Cell pellets were weighed after the supernatant had been removed. Cells were resuspended 5-10% (w/v) in 40 mM potassium phosphate buffer, pH 6.0. Cells were pre-incubated in potassium phosphate buffer for 5 min at 30° C. For each reaction, 330 µl pre-warmed buffer containing 20 mM glucose (0.55 µCi D-[U-$^{14}$C] glucose; 590 KBq/gmol, Amersham Pharmacia Biotech Inc.) was added to an equal volume of cells. 120 µl aliquot were withdrawn and transferred to the ice-cold water. Cells were harvested by vacuum filtration onto a glassfiber filters (GF/C, Whatman), and washed twice in 10 ml ice-cold water. Filters were transferred to scintillation vials containing 5 ml of Ultima Gold XR Scintillator liquid (Perkin Elmer). Radioactivity taken up by the cells was measured by liquid scintillation spectrometry. To determine substrate specificity for SWEET1 compared to D-glucose, a ten-fold excess of competing sugar species was used. To determine the pH-dependence of SWEET1 activity, 40 mM potassium phosphate uptake buffer at specified pH was used. Three independent transformants were used for uptake experiments.

*Xenopus* Oocytes Isolation and RNA Injection.

After linearization of the pOO2 plasmids with MluI, capped cRNAs were synthesized in vitro by SP6 RNA polymerase using mMESSAGE mMACHINE kit (Ambion, Inc., Austin, Tex.). *Xenopus laevis* oocytes were kindly provided by M. Goodman (Stanford University). Microinjection was carried out as described by Ballatori et al. 25 ng to 50 ng of each cRNA was injected into healthy-looking oocytes (RNAse-free water was used as control). The injected oocytes were then maintained at 18° C. in modified Barth's saline (MBS: (in mM) 88 NaCl, 1 KCl, 2.4 $NaHCO_3$, 0.82 $MgSO_4$, 0.33 $Ca(NO_3)_2$, 0.41 $CaCl_2$, and 20 HEPES-Tris, pH 7.5) with 100 µM gentamycin, 100 U/ml penicillin and 100 µM streptomycin solution for 2-3 d. The incubation buffer was changed once per day.

Tracer Uptake in *Xenopus* Oocytes.

The assay was performed with modification as described in Detaille et al. Two days after injection, groups of 7 to 16 oocytes were transferred into tubes containing 200 µL MBS and 1 mM D-glucose (4 µCi/ml D-[$^{14}$C(U)]-glucose; 319 mCi/mmol, PerkinElmer). After incubation at 20° C. for one hour, and the cells were washed by adding 1 ml ice-cold MBS. Incubation was stopped by adding ice-cold MBS buffer. The ooctyes were washed three times in ice-cold MBS buffer. The cells were solubilized with 100 µl 1% (w/v) SDS, and measured individually.

Tracer Efflux Assay in *Xenopus* Oocytes.

Efflux was measured essentially as described. Three days after cRNA injection, oocytes were injected with 50 nl solution containing 10 mM D-glucose with 0.18 µCi/µl D-[$^{14}$C(U)]-glucose. Cells were immediately washed once in MBS. At defined time points, the reaction buffer (950 µl) was removed for scintillation counting and replaced with fresh medium. Finally, the oocytes were solubilized with 1% SDS and analyzed for radioactivity.

Analysis of Glucose Accumulation in Yeast Cells by FRET Sensors.

FRET measurements in yeast cells were performed as described.

Plant Growth and Pathogen Infection.

*Arabidopsis* Col-0 plants were grown in growth chambers under 8 h light/14 h dark at 22° C. Five-week-old leaves were infiltrated with a 1 mM $MgCl_2$ buffer, $2\times10^8$ cfu/ml Pst DC3000 or Pst DC3000 ΔhrcU suspensions in 1 mM $MgCl_2$ using needleless syringes. Leaf samples were collected after 6, 12, and 24 h incubation in the light. *G. cichoracearum* inoculation was performed as described. Plants were placed in a "settling tower" (cardboard box) and *Arabidopsis* plants were inoculated with *G. cichoracearum* spores by holding infected squash leaves over the settling tower and using compressed air (duster cans) to blow the spores off of the squash leaves for settling onto *Arabidopsis* plants. The inoculum density was ~25-35 conidiospores/$mm^{-2}$. After inoculation, plants were incubated for 1 h in a dark dew chamber, then transferred to a growth chamber at 16 h day length and 70% relative humidity.

Alignment and Phylogenetic Analysis.

Multiple alignment of SWEET amino acid sequences was performed with CLUSTALW using default parameters, and a phylogenetic analysis was performed using the software Mega V3.1. Bootstrapping was performed 1000 times to obtain support values for each branch. For pair-wise comparison, multiple alignments of complete amino acid sequences were conducted using the Vector NTI advance 11.0.

Confocal Microscopy.

Imaging of plants expressing YFP::SWEET1 and YFP::SWEET8 was performed on a Leica TCS SP5 microscope. YFP was visualized by excitation with an argon laser at 514 nm and spectral detector set between 525 and 560 nm for the emission. The specimen were observed with 40/0.75-1.25NA HCX PL APO CS objective.

Results and Discussion

Sugar efflux is an essential process required for cellular exchange of carbon skeletons and energy in multicellular organisms and in interactions between organisms. Sugar efflux from the tapetum or transmitting tract of the style fuels pollen development and later on pollen tube growth. Flowers secrete sugars for nectar production to attract pollinators and plants secrete carbohydrates into the rhizosphere, potentially to feed beneficial microorganisms. Sugar efflux carriers are required at many other sites, including the mesophyll in leaves and the seed coat. The molecular nature of the efflux transporters is unknown. Plant-derived sugars also provide a substrate for pathogens. The primary goal of pathogens is to access nutrients from its host plant to efficiently reproduce. Phytopathogenic bacteria in the genera *Pseudomonas* and *Xanthomonas* can live in the extracellular space (apoplasm) of plant tissue, where they acquire carbohydrates as their source of energy and carbon skeletons. Successful pathogens likely co-opt such mechanisms to alter nutrient flux. As a consequence, pathogens and plants engage in an evolutionary tug-of-war in which the plant tries to limit pathogen access to nutrients and initiates defense strategies, while the pathogen devises strategies to gain access to nutrients and suppress host immunity. Insight to the mechanisms used by pathogens to alter plant defenses is now emerging; however, little is known about how pathogens alter host physiology, notably sugar export, to support pathogen growth. We thus postulated the existence of transporters, either vesicular or at the plasma membrane, that secrete sugars. We also hypothesized that these plant efflux transporters are 'co-opted' by pathogens to supply their nutrient requirements. At least in the case of wheat powdery mildew, glucose is the main sugar transferred from plant host to pathogen. Respective pathogen glucose/H+ cotransporters have been identified; in contrast, the plant sugar efflux mechanisms have remained elusive.

Figure 12:
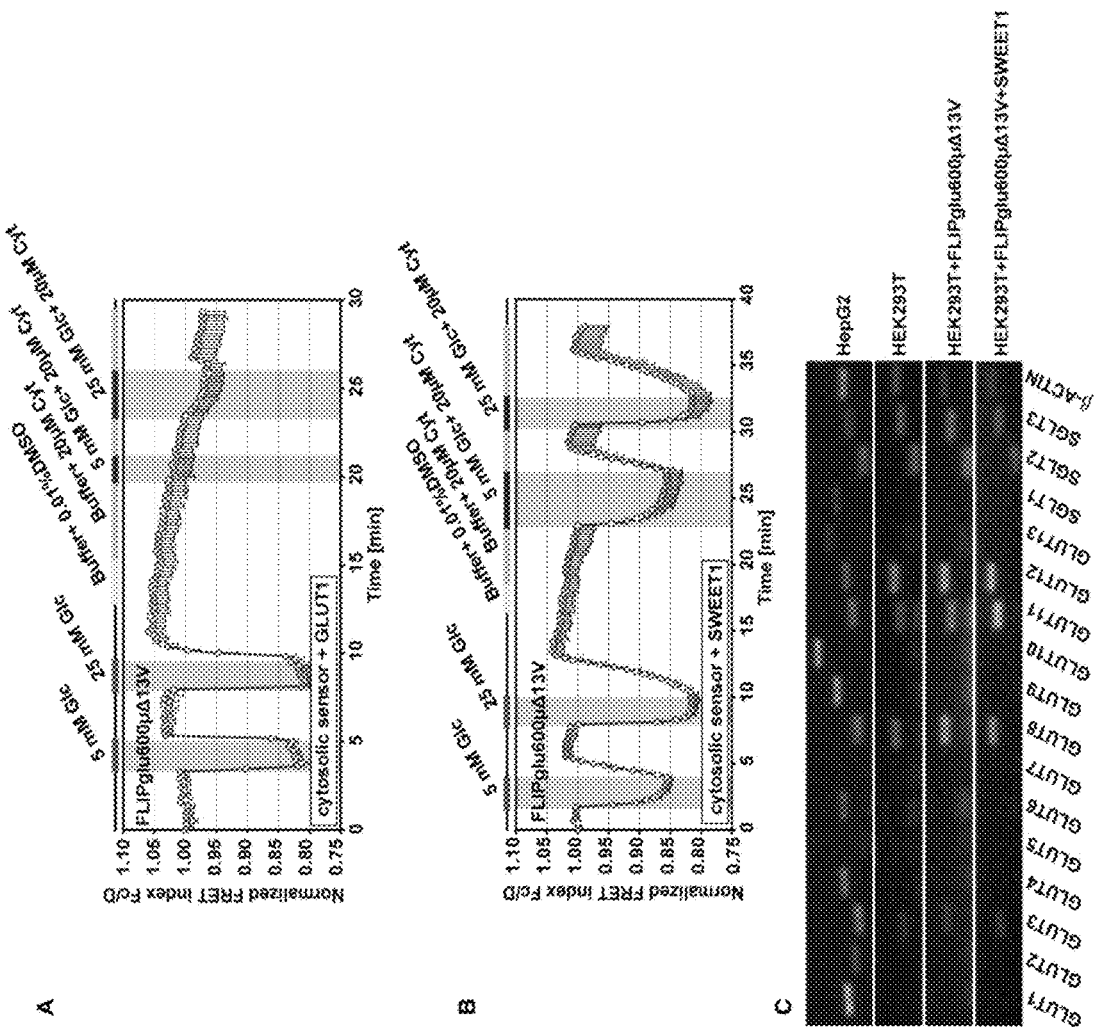
FIG. 12 shows evidence for SWEET-mediated glucose transport in HEK293T cells.
Figure 13:
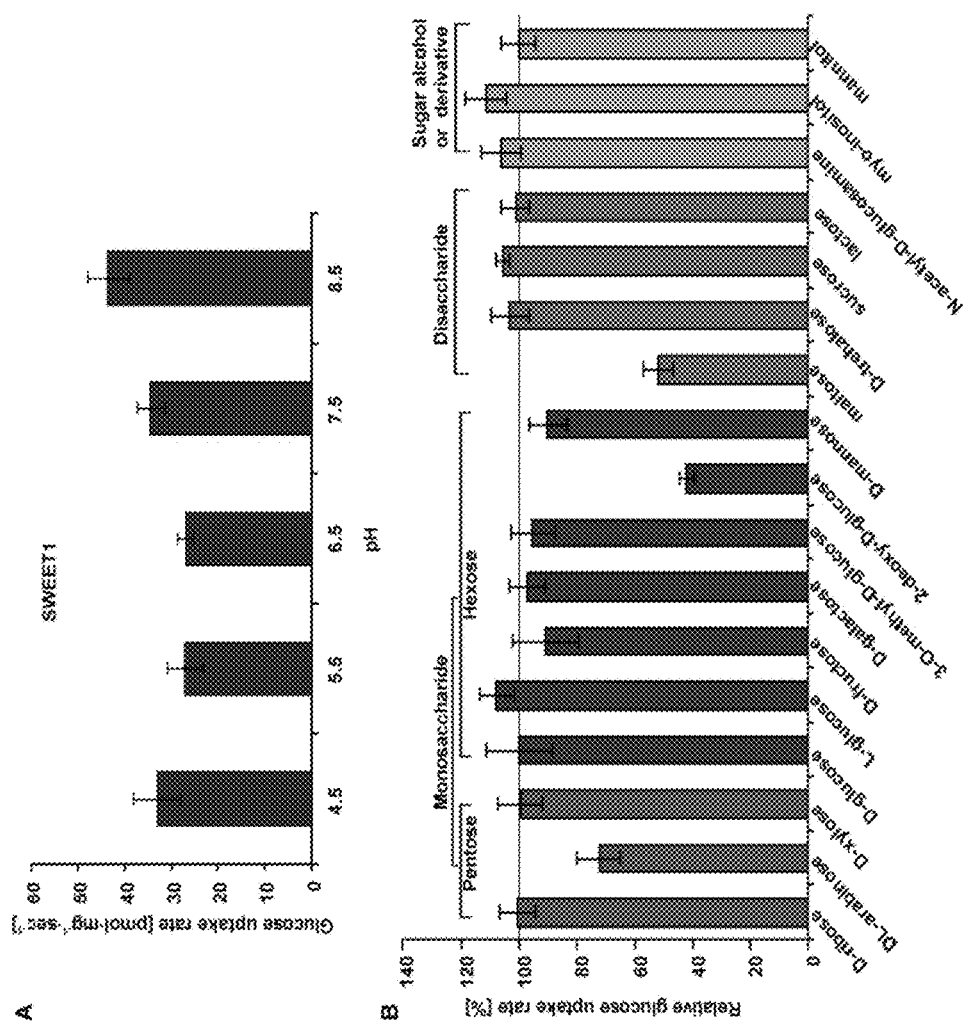
FIG. 13 show biochemical properties of SWEET1.
Figure 14:
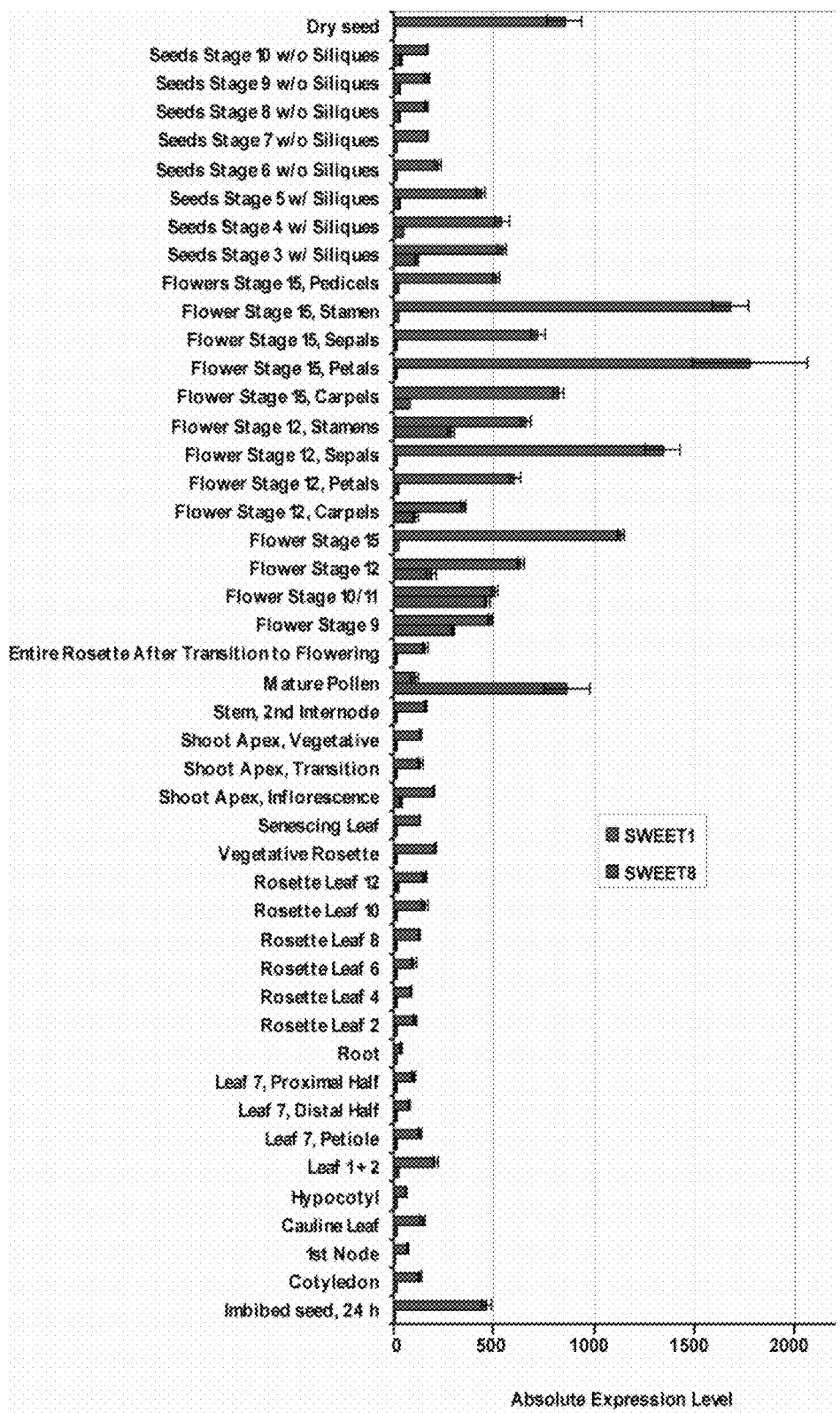
FIG. 14 shows tissue specific expression pattern of SWEET1 and SWEET8 genes in *Arabidopsis*. The analysis is based on microarray studies from the *Arabadopsis* eFP Browser, which is available on the internet at "bar.utoronto.ca/efp/cgi-bin/efpWeb.cgi".

To identify novel glucose transporters from the reference plant *Arabidopsis*, genes encoding uncharacterized polytopic membrane proteins from the plant membrane protein database Aramemnon, available on the internet at "aramemnon.botanik.uni-koeln.de", were screened using a mammalian expression system. Candidate genes were coexpressed with a high-sensitivity FRET glucose sensor (i.e. FLIPglu600μΔ13V) in human embryonic kidney HEK293T cells, which are characterized by low endogenous glucose uptake activity. Among the genes tested, SWEET1 (AT1G21460) expression enabled HEK293T cells to accumulate sugars as detected by glucose-dependent negative FRET ratio change; consistent with a transport function (FIG. 9A). To determine whether SWEET1 can also mediate efflux from the cytosol, we expressed the FRET glucose sensor FLIPglu600μΔ13V$^{ER}$ in the lumen of the endoplasmic reticulum (ER; FIG. 9B). Topologically, uptake across the plasma membrane (PM) is initiated from the extracellular side of the carrier, while 'export' to the ER is initiated from the cytoplasmic side of the transporter (FIG. 9C). The glucose-dependent response of the ER sensor demonstrates that SWEET1 can mediate uptake across the PM and 'efflux' into the ER. SWEET1 may thus function as a glucose uniporter, for which the direction of transport depends only on the glucose gradient across the membrane. Endogenous glucose transporters (GLUTs) in HEK293T cells were not involved in glucose uptake because the GLUT inhibitor cytochalasin B did not affect SWEET1-induced glucose uptake (FIG. 12A). Furthermore, the mRNAs levels of known human glucose transporters in the GLUT and SGLT families were not induced in HEK293T cells expressing SWEET1 (FIG. 12B). To independently demonstrate that SWEET1 activity is required for glucose uptake, SWEET1 was expressed in a yeast mutant lacking all 18 hexose transporters. SWEET1 enabled the yeast mutant to grow on glucose (FIG. 9D) and to accumulate intracellular glucose as determined using the FRET glucose sensor FLII$^{12}$Pglu700Δ∂6 (FIG. 9E). Further characterization revealed that SWEET1 functions as a low affinity transporter in yeast with a $K_m$ for glucose of 9 mM (FIG. 9F). Consistent with a uniport transport mechanism, uptake was not stimulated by energization, and was largely pH-independent (FIG. 13A). Similar to the glucose transport activity described in *Arabidopsis* roots, SWEET1-mediated uptake was marginally inhibited by the glucose analog 3-O-methylglucose (FIG. 13B). In support of a role in cellular uptake and efflux, a constitutively expressed SWEET1-YFP fusion localizes to the PM in *Arabidopsis* leaves (FIG. 9G). Based on microarray studies, SWEET1 is only weakly expressed in roots, but highly expressed in *Arabidopsis* flowers, suggesting a role in supplying nutrients to the gametophyte or nectaries (FIG. 14). Despite the striking similarity of the biochemical properties of a putative sugar transporter in the root system, SWEET1 expression in roots is low, suggesting that it does not play a major role glucose efflux from roots. Other proteins, possibly related to SWEET1, may be involved in sugar transport in roots.

SWEET1 is the first characterized member of a novel transporter family (PFAM PF03083) with 17 members in *Arabidopsis* and 19 in rice (FIG. 1). *Arabidopsis* SWEETs are diverse, falling into four subclades (FIG. 1A) with identities ranging between 28 and 86% (Tables 1 and 2). Consistent with functions in transport, SWEETs are small hydrophobic proteins predicted to form a hydrophobic pore built by 7 transmembrane helices (TMH). In silico analysis suggests that the 7 TMHs in SWEETs resulted from an ancient duplication of a 3-TMH domain polypeptide (1-3 and 5-7) fused via TMH 4 (FIG. 9H).

Figure 15:
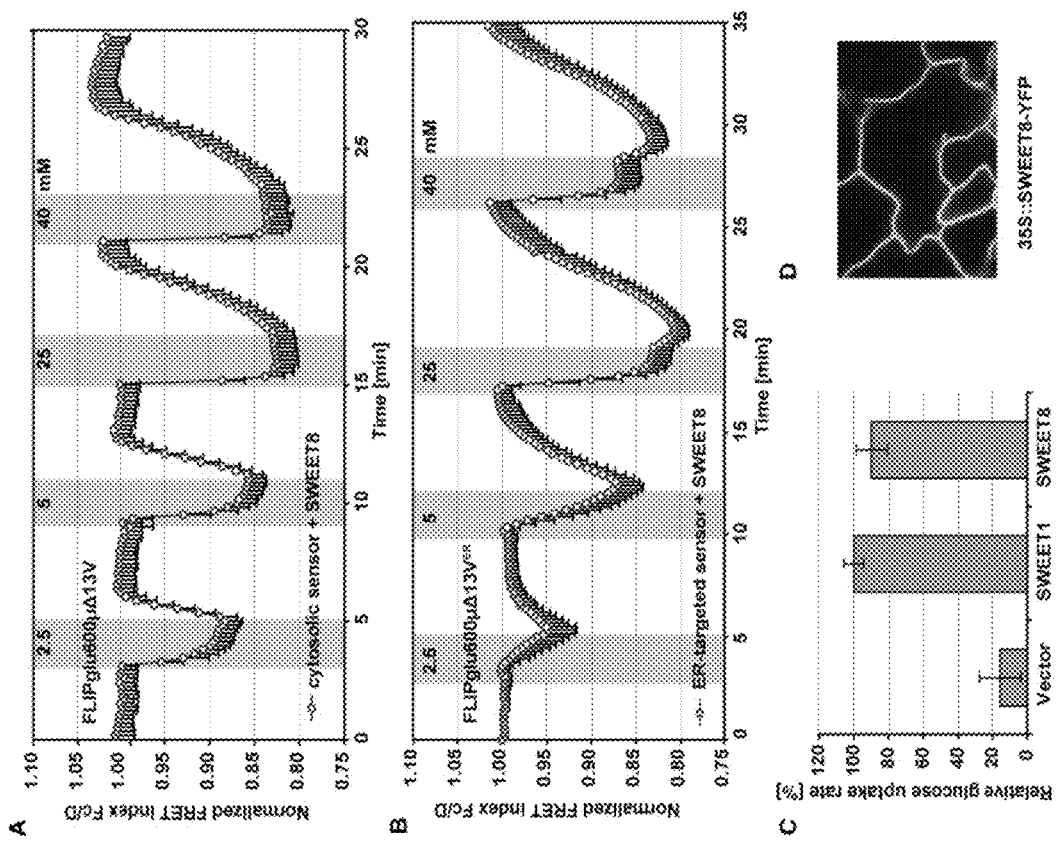
FIG. 15 shows a functional analysis of SWEET8 in heterologous systems.

While none of the members of this family had been characterized functionally, phenotypes of several SWEET mutants have been described. SWEET1 is 41% identical to its paralog SWEET8, and belongs to the second of the four *Arabidopsis* SWEET clades. Mutation of SWEET8/RPG1 had been shown to lead to male sterility. Coexpression of SWEET8/RPG1 with the FRET sensors FLIPglu600μΔ13V or FLIPglu600μΔ13V$^{ER}$ in HEK293T cells suggests that SWEET8 also functions as a uniporter (FIG. 15A; FIG. 9C). Moreover SWEET8/RPG1 complements the yeast glucose transport mutant (FIG. 9D). SWEET8/RPG1 is expressed the tapetum, strongly suggesting a role as a glucose effluxer necessary for pollen nutrition.

SWEET1 and SWEET8 share 34% amino acid sequence identity with the rice protein OsSWEET11/Os8N3 (named OsSWEET11 based on phylogeny, FIG. 1). The closest *Arabidopsis* homolog shares 40% identity with OsSWEET11/Os8N3 and belongs to the third SWEET clade (FIG. 1). Similar to SWEET8, OsSWEET11/Os8N3 appears to function in pollen nutrition since a reduction of its expression by RNA-inhibition led to reduced starch content in pollen as well as pollen sterility. Silencing of *Petunia*

Nec1, another homolog of SWEETs in clade 3 (FIG. 1) also led to male sterility. Nec1 is expressed in nectaries, and its developmental regulation correlated inversely with starch content of the nectaries, suggesting a second role for Nec1 in sugar secretion in nectaries. Taken together, these data strongly suggest that in both mono- and dicotyledonous plants SWEETS play a crucial role in supplying carbohydrates to key reproductive purposes.

Figure 10:
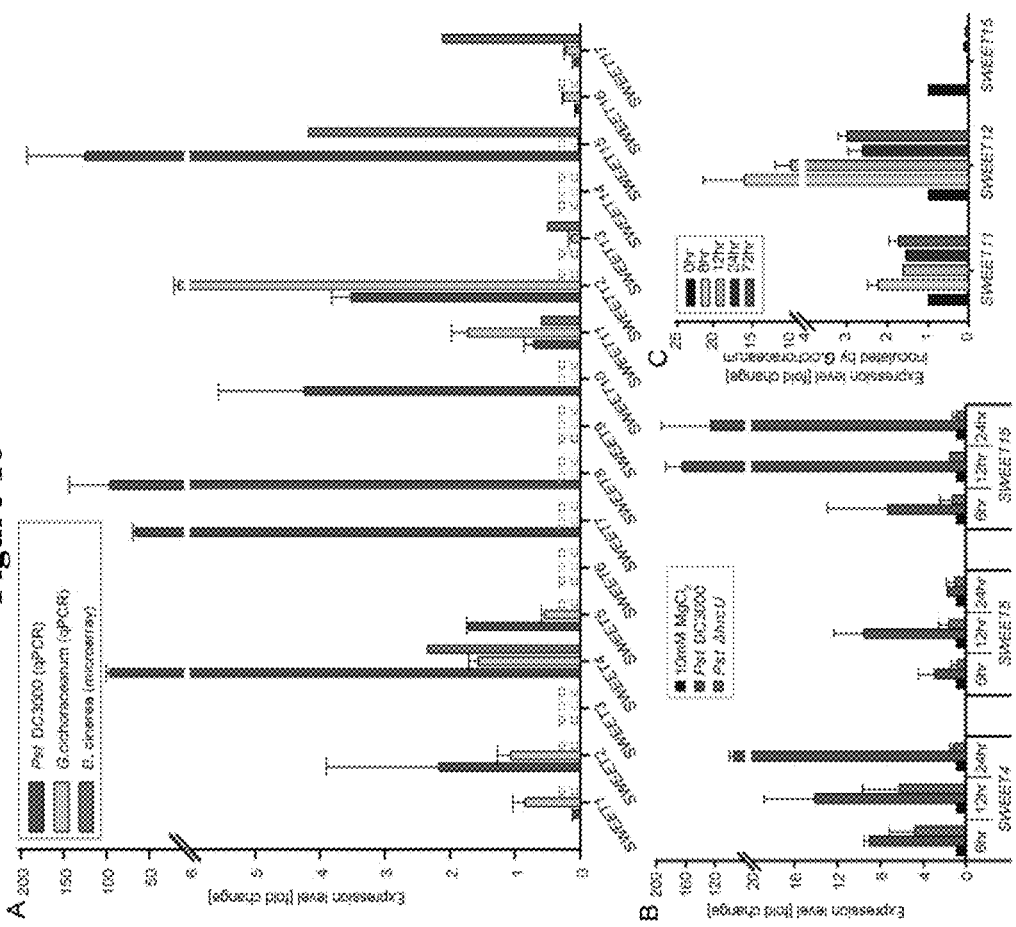
FIG. 10 shows biotrophic bacteria or fungi induce mRNA levels of different SWEET genes.

Pathogens use the host plant's photosynthetic capacity to provide energy and nutrients to grow and reproduce. It has been well established that a wide variety of pathogens acquire glucose from their hosts. It was hypothesized that different pathogens highjack the host sugar efflux systems dedicated for plant development, such as feeding of the gametophyte. Accordingly, it was then tested whether the mRNA levels of *Arabidopsis* SWEET family members are altered by bacterial and fungal pathogens (FIG. 10). *Pseudomonas syringae* pv. tomato strain DC3000 infection highly induced SWEET4, 5, 7, 8 and 15 mRNA levels in *Arabidopsis* leaves. In contrast, the DC3000 type III secretion mutant (ΔhrcU), which cannot inject type III effector proteins into the host and is thus compromised in pathogenicity, did not induce four of the five genes demonstrating that SWEET mRNA abundance is modulated in a type III-dependent manner. It was then tested whether other pathogens target the same or different family members. The powdery mildew fungus *Golovinomyces cichoracearum* induced a different set of SWEET mRNAs, most prominently SWEET12 (FIG. 10A, C). Microarray data showed that the fungal pathogen *Botrytis cinerea* targets again a different set of SWEETs (i.e. SWEET4, 15, 17). Taken together, pathogen-specific modulation of SWEET mRNA levels likely alters sugar transport at the site of infection impacting pathogen growth and plant immunity.

Figure 16:
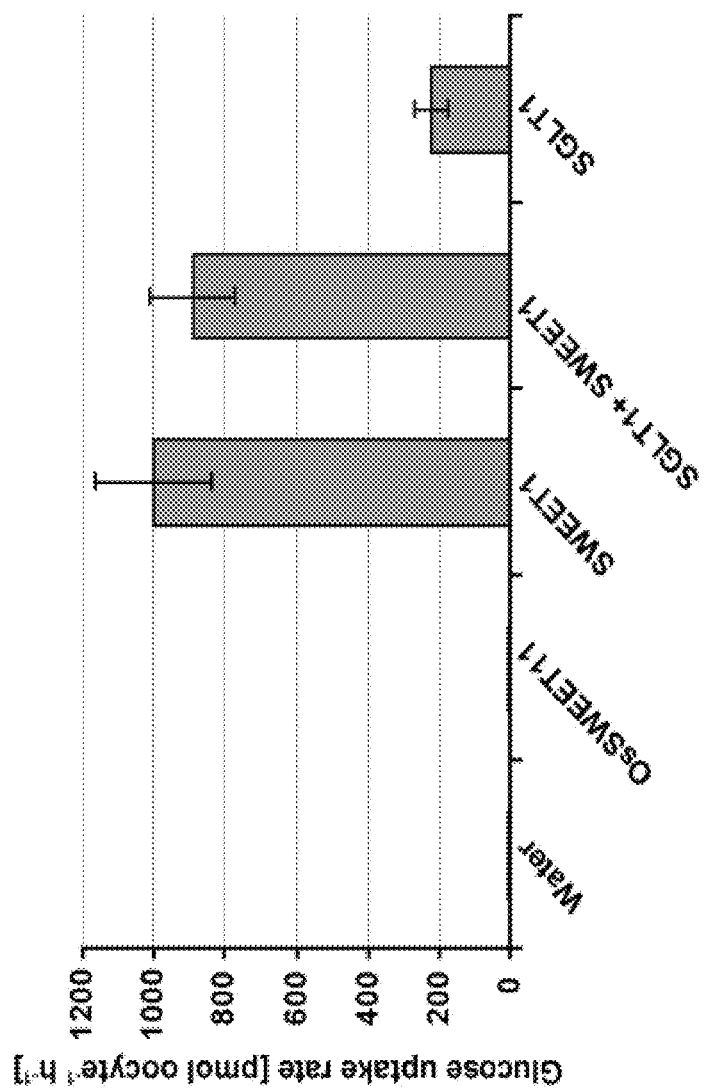
FIG. 16 shows SWEET-mediated glucose uptake in *Xenopus* oocytes. Relative glucose uptake rate in oocytes injected with water as control, SWEET1, OsSWEET11, SGLT1 or SGLT1 together with SWEET1 (time=1 h; 1 mM D-glucose; 4 μCi/ml [$^{14}$C]-D-glucose). Data are mean±SD, n>9.
Figure 17:
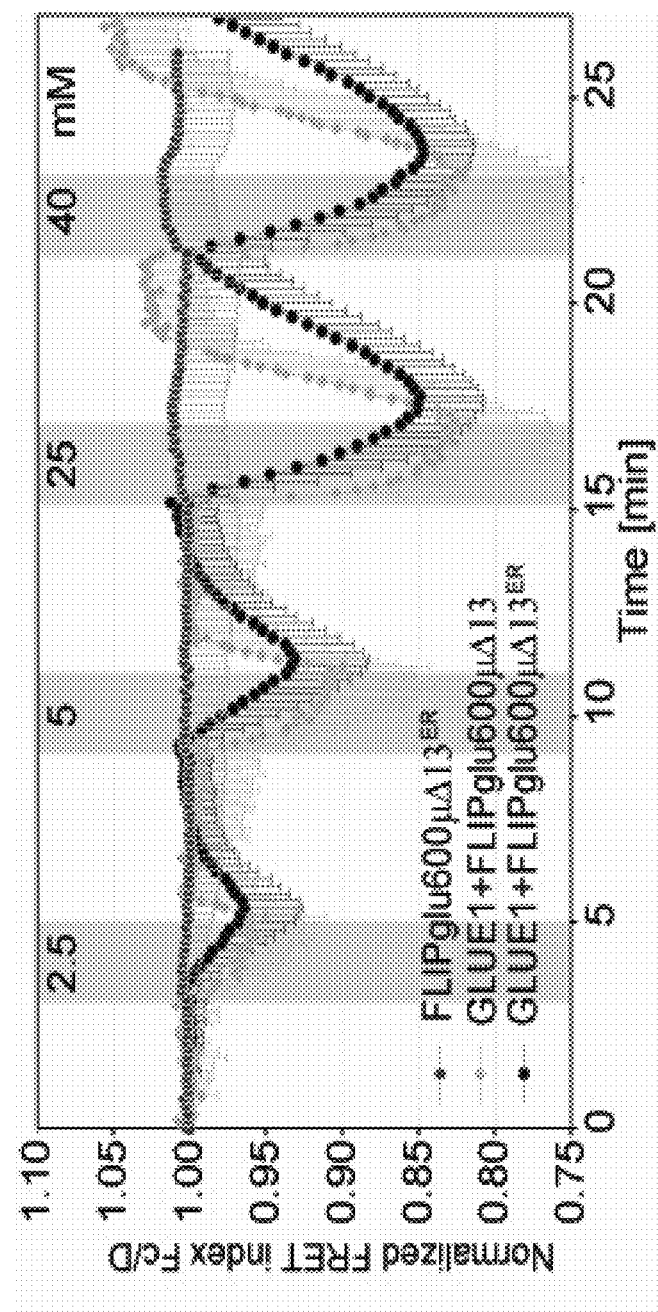
FIG. 17 shows real time accumulation of glucose in HEK293T cells. GLUE1 was coexpressed with cytosolic or ER FRET sensor FLIPglu600μΔ6 in HEK293T cells. The normalized emission ratio of CFP and YFP is shown on the Y-axis. Negative FRET ratio changes indicate that GLUE1 function as glucose transporter and effluxer as well.
Figure 18:
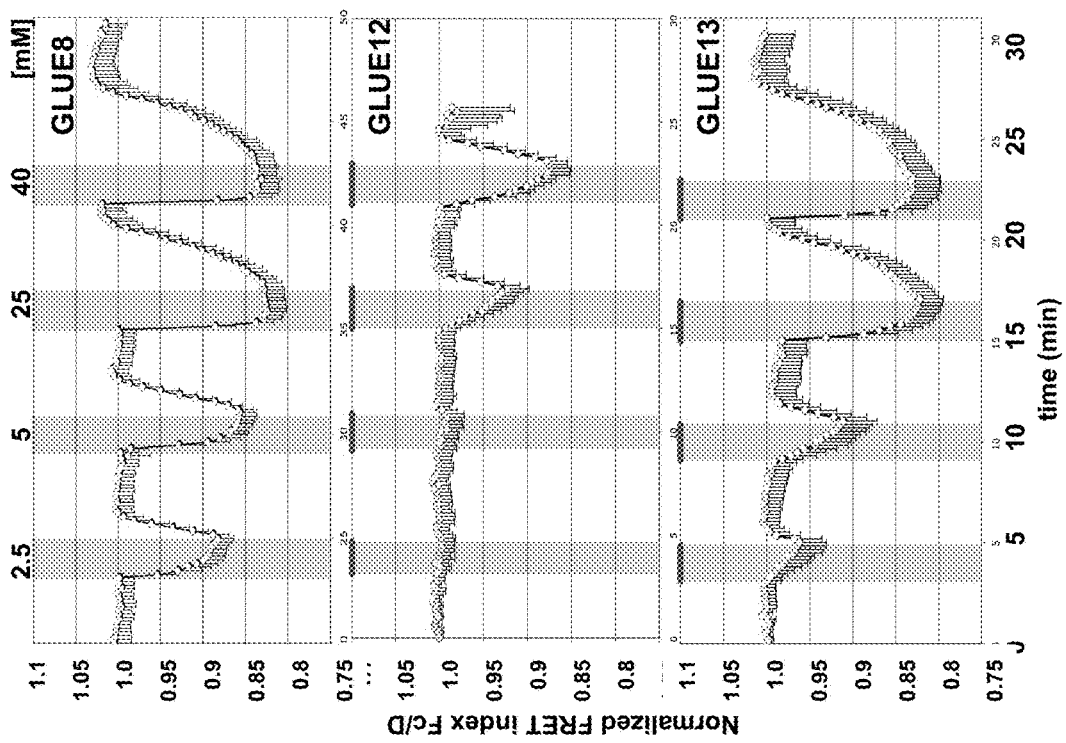
FIG. 18 shows GLUE8, 12, and 13 were coexpressed with cytosolic FRET sensor FLIPglu600μΔ6 in HEK293T cells. The normalized emission ratio of CFP and YFP is shown on the Y-axis. Negative FRET ratio changes in cytosol indicate that GLUE8, 12, and 13 function as glucose transporters with different activities.
Figure 43:
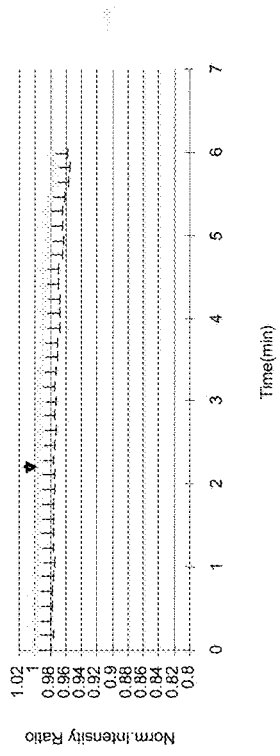
FIGS. 43A through 43H show sucrose exporting function of SWEETs in HEK293 cells (Positive control (potato sucrose transporter StSUT1; Riesmeier et al. 1993 Plant Cell) is 43A, negative control (empty vector 43B). Uptake of sucrose was determined using the FRET sucrose sensor FLIPsuc90µΔ1 (Chaudhuri et al., 2008 Plant Journal). SWEET 10 (FIG. 43C), SWEET 11 (FIG. 43D), SWEET12 (FIG. 43E), SWEET 13 (FIG. 43F), SWEET 14 (FIG. 43G), and OsSWEET11/Os8N3 (FIG. 43H) showed a negative FRET response (negative ratio change corresponds to an increase in cytosolic sugar content) similar to the one for the positive control StSUT1 indicating sucrose uptake into the mammalian cell. This uptake could be mediated by uniport (facilitated diffusion), proton symport or proton antiport.
Figure 43:
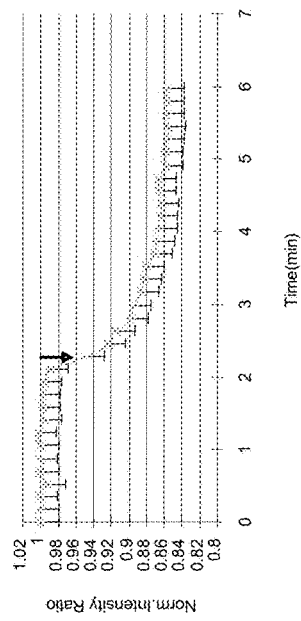
Figure 43:
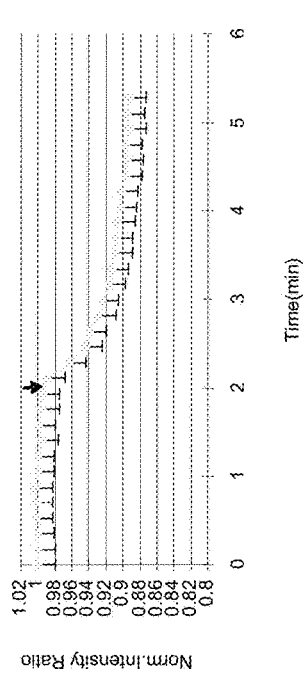
Figure 43:
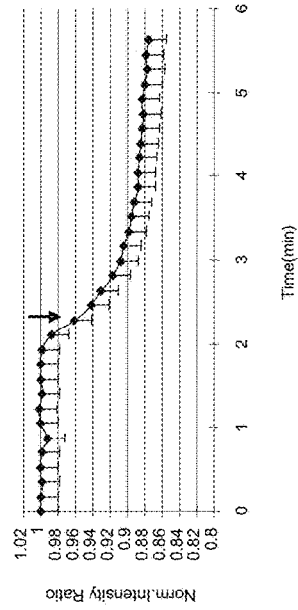
Figure 43:
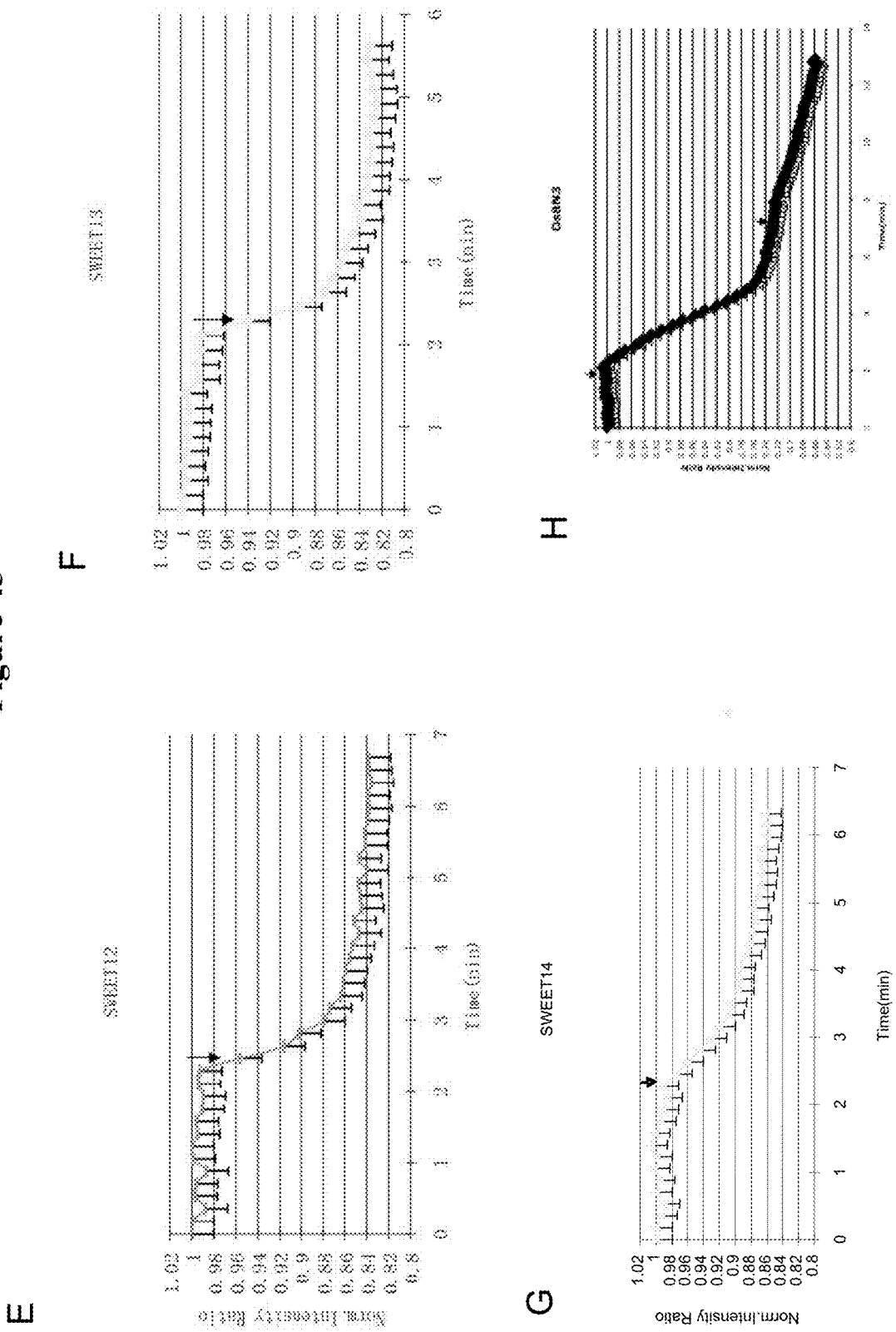

Consistent with this hypothesis, the rice gene OsSWEET11/Os8N3, which is important for pollen nutrition, functions as a pathogen susceptibility factor. The rice ossweet11/os8n3 mutant was found to be resistant to the bacterial pathogen *Xanthomonas oryzae* pathovar *oryzae* (Xoo) strain PXO99$^4$, strongly suggesting that OsSWEET11/Os8N3 supplies sugars to the pathogen during infection (FIG. 11A). Accordingly, it was tested whether OsSWEET11/Os8N3 also functions as a glucose transporter. Unlike SWEET1 and SWEET8, OsSWEET11/Os8N3 did not mediate glucose uptake in HEK293T cells and did not complement the yeast hexose transport mutant (data not shown), indicating that it does not function in glucose uptake. It was however conceivable that OsSWEET11/Os8N3 functions as a glucose effluxer. To test this hypothesis, OsSWEET11/Os8N3 was expressed in *Xenopus* oocytes, a system amenable for efflux studies. OsSWEET11, in contrast to SWEET1 and the mammalian Na$^+$-dependent glucose transporter SGLT1, was also not able to mediate [$^{14}$C]-glucose uptake into oocytes (FIG. 9I; FIG. 16). However, coexpression of SGLT1 and OsSWEET11/Os8N3 led to reduced [$^{14}$C]-glucose accumulation in the oocytes, a finding compatible with an efflux (i.e. 'leak') activity of OsSWEET11/Os8N3 (FIG. 9I, K). The hypothesis that OsSWEET11/Os8N3 can export glucose is corroborated by direct efflux measurements. Glucose efflux was measured by injecting [$^{14}$C]-glucose into oocytes expressing the plant proteins. SWEET1 and OsSWEET11/Os8N3 were both able to efflux [$^{14}$C]-glucose (FIG. 9G), suggesting that while SWEET1 functions as a facilitator, OsSWEET11/Os8N3 is an effluxer (potentially a H$^+$/glucose antiporter). Moreover, OsSWEET11 (Os8N3) can transport sucrose (FIG. 43G).

Thus, OsSWEET11/Os8N3 appears to be recruited by the pathogen to provide glucose and sucrose for reproduction.

Figure 11:
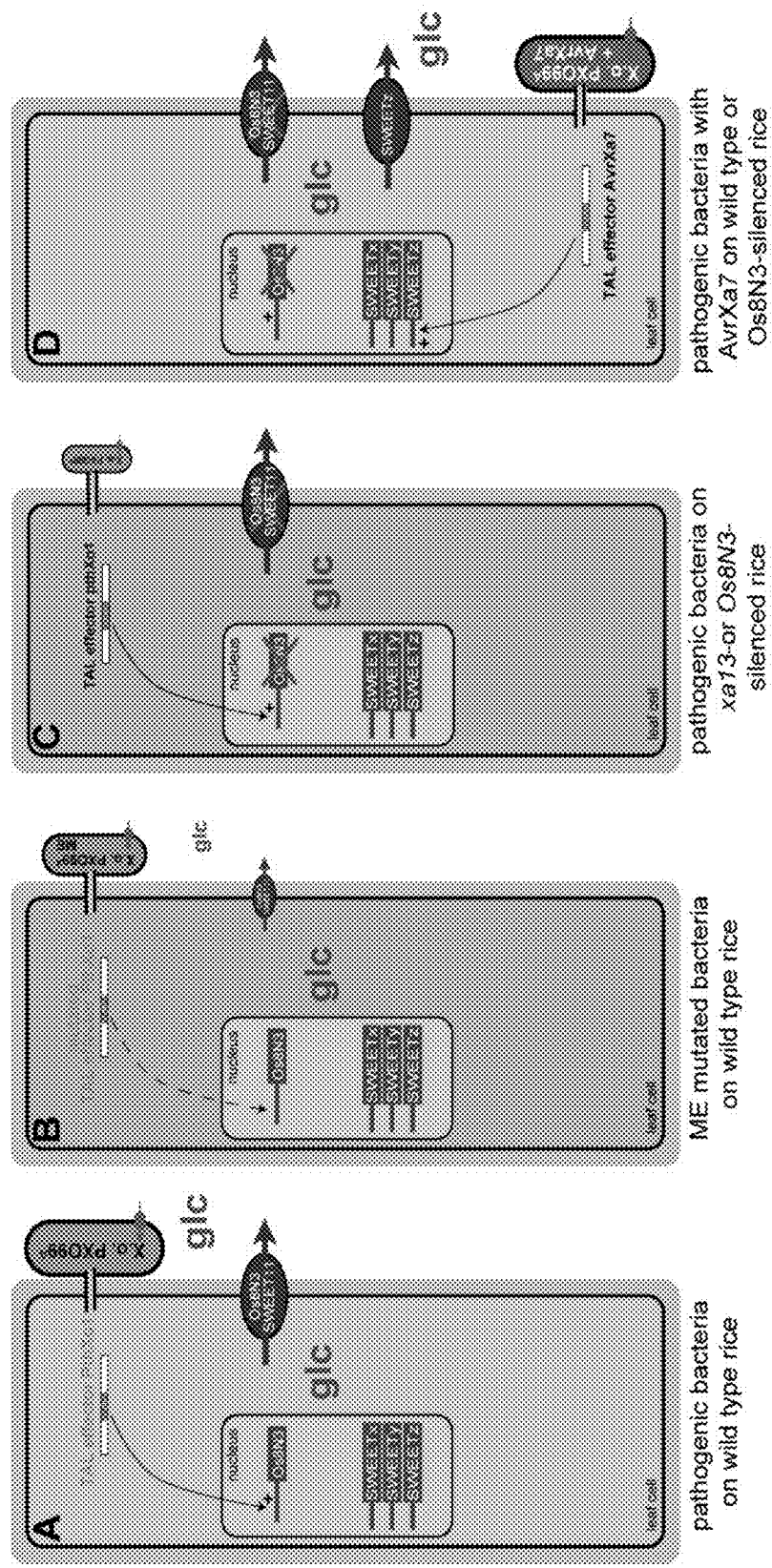
FIG. 11 shows a schematic model for the role of SWEETs in nutrition of pathogens.

The finding that OsSWEET11/Os8N3 functions as a sugar effluxer provides a model of how pathogens co-opt basic plant function to gain access to the plant's energy resources (FIG. 11). Xoo strain PXO99$^4$ depends on the type III effector gene pthXo1 for infection of rice. PthXo1 is a TAL (transcriptional activator-like) effector, which directly interacts with DNA to promote transcription of target genes. PthXo1 secreted by Xoo PXO99$^4$ specifically activates transcription of OsSWEET11/Os8N3, presumably to induce sugar efflux in order to feed the apoplasmic bacteria (FIG. 11A). When PthXo1 is mutated (ME), transcription of OsSWEET11/Os8N3 and pathogenicity are reduced, consistent with starvation of the pathogen (FIG. 11B). If OsSWEET11/Os8N3 becomes unavailable due to mutation or RNA inhibition, sugar (e.g. glucose, glc) would not be exported in sufficient amounts and the pathogen would starve (FIG. 11C). Indeed, ossweet11/os8n3 mutants are resistant to Xoo PXO99$^4$. PXO99$^4$ bacteria carrying another TAL effector (AvrXa7) are virulent even in the ossweet11/os8n3 mutant (FIG. 11D), compatible with the most parsimonious hypothesis that other SWEETs are co-opted by the pathogen to support bacterial growth (FIG. 11D). Indeed, the predicted DNA sequence targeted by PthXo1 is TRCA•CT•CCATTACTRTAAAA•N• (SEQ ID NO: 125) (found in the promoter upstream of OsSWEET11/Os8N3), whereas that targeted by AvrXa7 is TA•AANCRCCCN••CCNNRRATRA•N (SEQ ID NO: 126). This sequence was not sufficient to identify the potential targets. These findings support the notion that besides their role in immunity, type III effectors are also involved in providing access to nutritional resources of the host plant. How fungal pathogens target promoters of these transporters is not understood yet, however the transporter genes may be suitable diagnostic tools to unravel the regulatory networks supporting fungal growth. Apparently, in order to be maintained in evolution despite this high pathogen-based selection pressure, SWEET transporters must have essential functions in the plant; the analysis of mutants suggests that at least one of them plays a role in supplying carbohydrates to the gametophyte. Thus, the activities of the other paralogs may also be critical to other plant functions. Characterization of the remaining SWEET paralogs and analysis of mutants especially with regard to disease susceptibility will be important next steps.

Knowledge of the full spectrum of pathogen effector molecules and how they disrupt plant metabolism to favor pathogen growth will improve our understanding of host-pathogen interactions and may lead to new strategies for combating pathogen infections, which at the global scale lead to crop losses of over 10% annually. Moreover, analysis of the other genes in the SWEET family may help solve some of the riddles of pollen nutrition, nectar production and carbon sequestration from plant roots. Interestingly, animal genomes contain SWEET homologs also involved in sugar transport.

Example 7

A Third Family of Glucose Transporters in *C. elegans* and Humans

Materials and Methods

The ORF of SGLT1 (Invitrogen, Carlsbad, Calif.) was amplified by PCR and cloned into pCR2.1-TOPO (Invitrogen). The SGLT1 ORF was excised with EcoRI/XhoI and cloned into the corresponding sites in pOO2. The splice variant RAG1AP1-1 in pDNR-LIB (Clone ID: 4076256, Open Biosystems, Huntsville, Ala.) was restricted with EcoRI/XhoI and cloned into pOO2. RAG1AP1-2 in pCMV-SPORT6 (Clone ID: 3896154, Open Biosystems, Huntsville, Ala.) was transferred into the pOO2-GW (D. Logué, unpublished) by in vitro LR recombination (Gateway). RAG1AP1-3aa was mutated to Y216A, L218A, L219A (putative internalization motifs) by site-directed mutagenesis and cloned by in vitro BP recombination in pDONR221-f1 and further mobilized into pOO2-GW by LR reaction. CeSWEET1 (K02D7.5), CeSWEET3 (C06G8.1), CeSWEET4 (Y39A1A.8), CeSWEET5 (K06A4.4), and CeSWEET7 (K11D12.5) (Open Biosystems, Huntsville, Ala.) were cloned into pOO2-GW using LR reactions. Subsequently, a start and stop codon was added using site directed mutagenesis. Oocyte expression and transport studies were performed as described by Chen et al, except that for all uptake experiments oocytes were preincubated in 1 mM glucose in MBS overnight.

Results and Discussion

The *C. elegans* genome contains 7 homologs of a novel class of sugar efflux transporters (SLC50), while the human genome has a single homolog, named RAG1AP1. Similar to the *Arabidopsis* SWEET1, *C. elegans* CeSWEET1 mediates glucose uptake when expressed in *Xenopus* oocytes. CeSWEET1 as well as human RAG1AP1 counteract secondary active glucose accumulation in oocytes mediated by the Na$^+$/glucose cotransporter SGLT1. Mutation of CeSWEET1 led to fat accumulation, compatible with a defect in cellular glucose efflux leading to accumulation of lipids. These findings may shed new light on a role of the human homolog RAG1AP1 in sugar transport.

Figure 19:
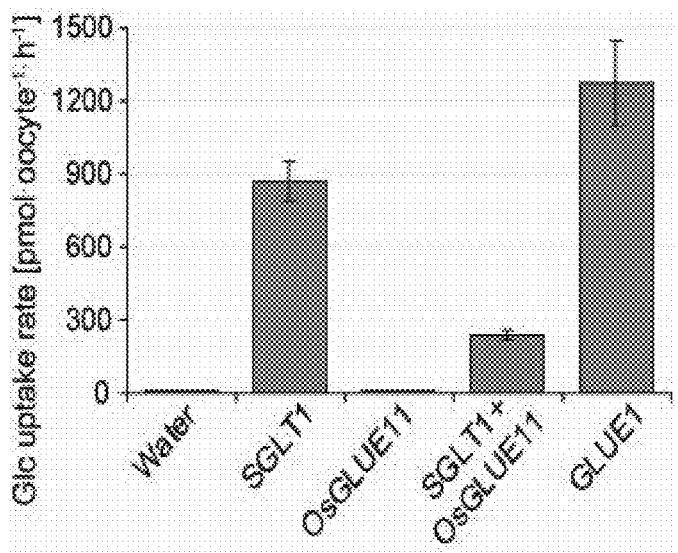
FIG. 19 shows functional expression of GLUEs in *Xenopus* ooxytes.
Figure 19:
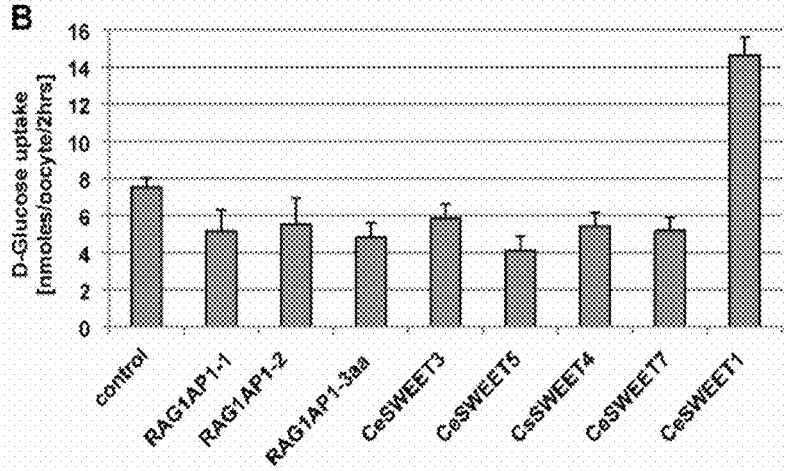
Figure 19:
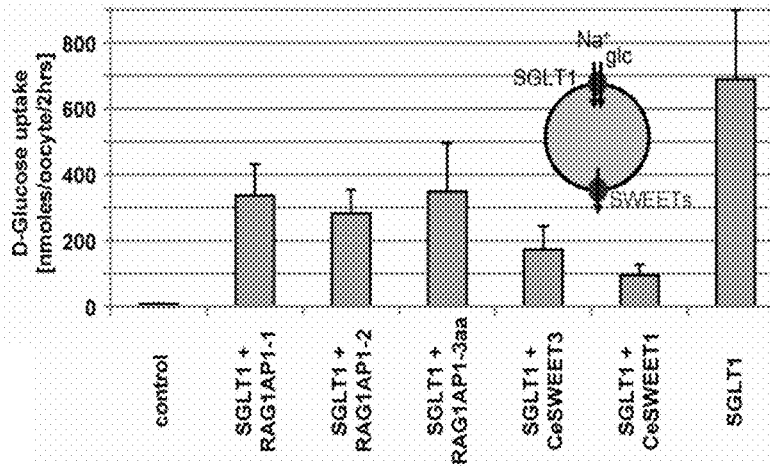
Figure 20:
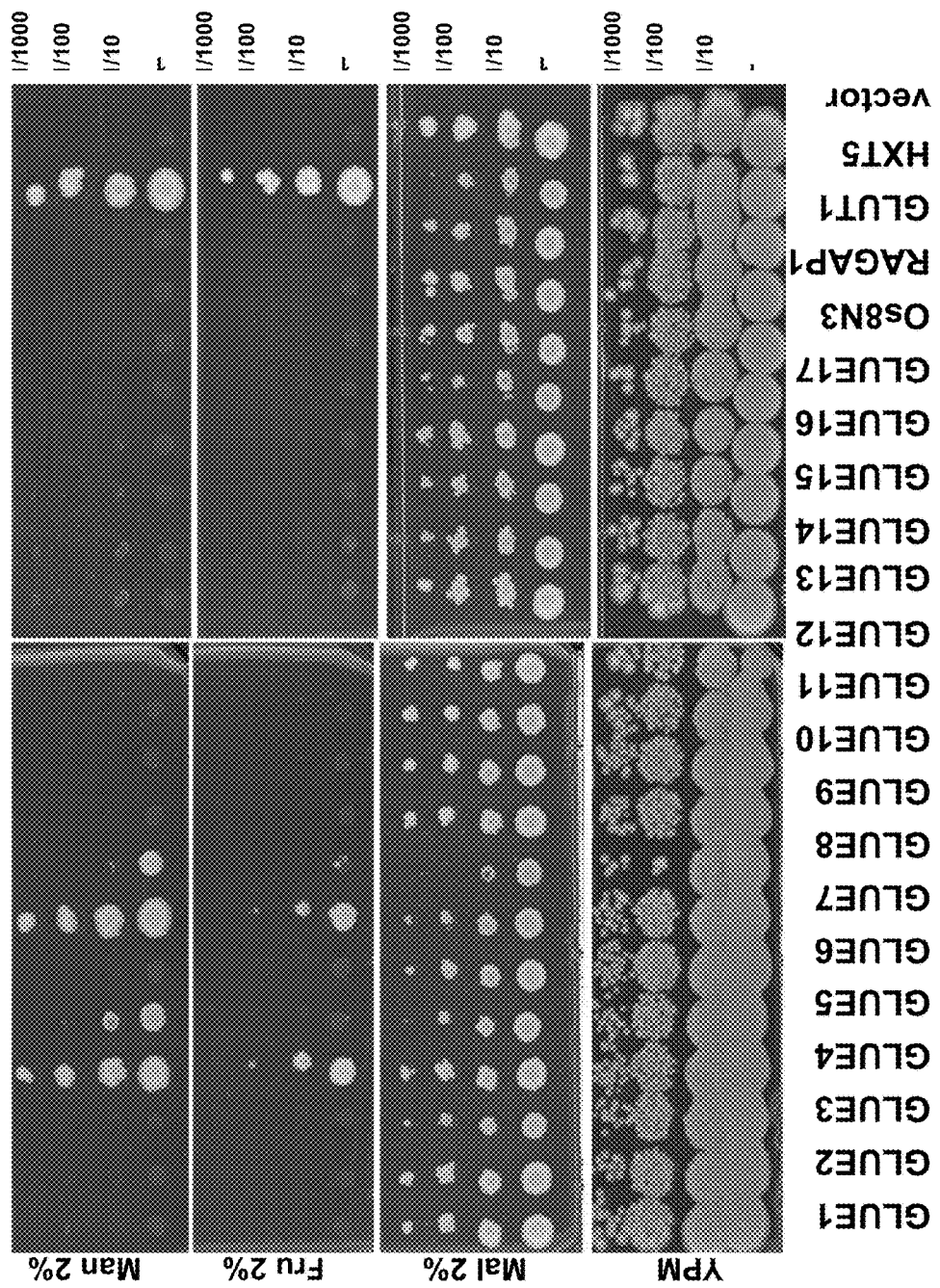
FIG. 20 shows complementation of yeast strain YSL2-1 lacking all 18 hexose transporter genes with 17 *Arabidopsis* GLUE genes. Cells expressing yeast homolog, HXT5, or mammalian homolog, GLUT1, were used as controls. Os8N3 and RAG1AP1 were homologs from rice and mammalian. The yeast cells were grown in SD-Ura liquid medium with 2% maltose to early log phase and 5 m of serious dilutions were spotted on the media containing YPM or SD-URA containing 2% of maltose, fructose, or mannose. GLUE4 and GLUE7 transport fructose and mannose. GLUE5 and 8 transport mannose.
Figure 21:
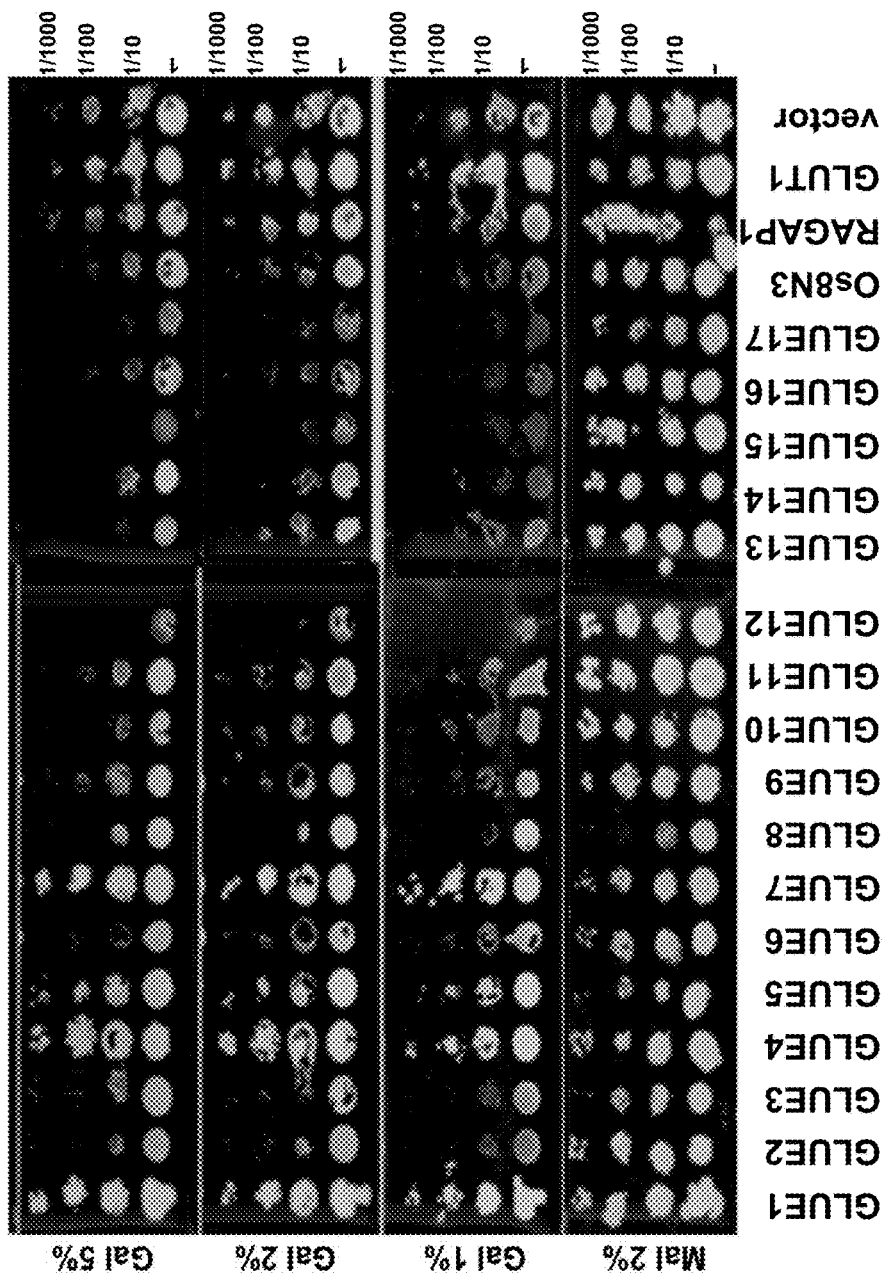
FIG. 21 shows complementation of yeast strain YSL2-1 lacking all 18 hexose transporter genes with 17 *Arabidopsis* GLUE genes. Cells expressing mammalian homolog, GLUT1, were used as controls. Os8N3 and RAG1AP1 were homologs from rice and mammalian. The yeast cells were grown in SD-Ura liquid medium with 2% maltose to early log phase and 5 m of serious dilutions were spotted on the media containing SD-URA containing various concentrations of galactose. Except for GLUE1, 4, 5, and 7, all others are sensitive to 5% galactose, indicating the capability to mediate galactose transport.
Figure 22:
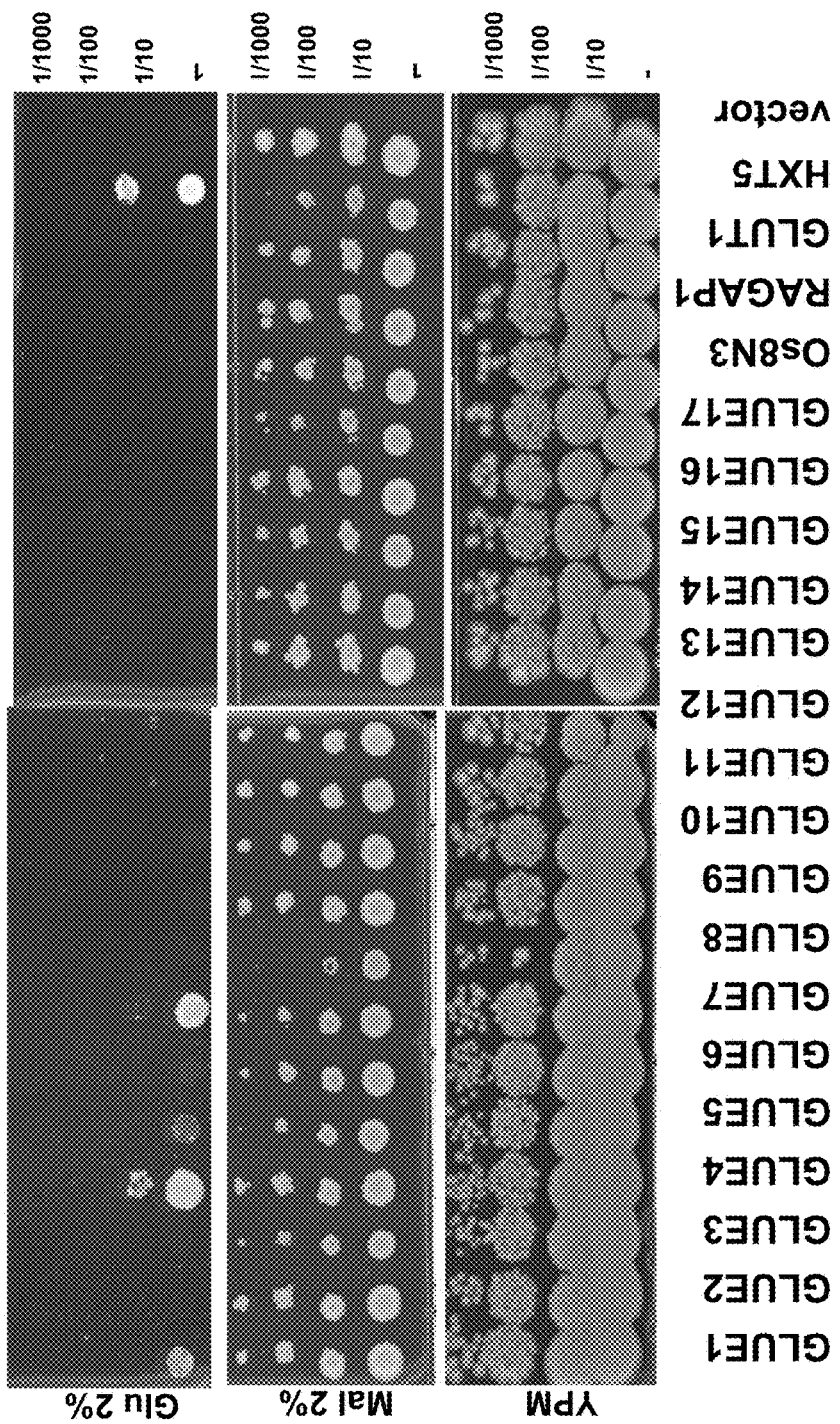
FIG. 22 shows complementation of yeast strain YSL2-1 lacking all 18 hexose transporter genes with 17 *Arabidopsis* GLUE genes. Cells expressing yeast homolog, HXT5, or mammalian homolog, GLUT1, were used as controls. Os8N3 and RAG1AP1 were homologs from rice and mammalian. The yeast cells were grown in SD-Ura liquid medium with 2% maltose to early log phase and 5 m of serious dilutions were spotted on the media containing YPM or SD-URA containing 2% glucose. GLUE1, 4, 5 and 7 transport glucose (GLUE8 as well, but not shown here).
Figure 23:
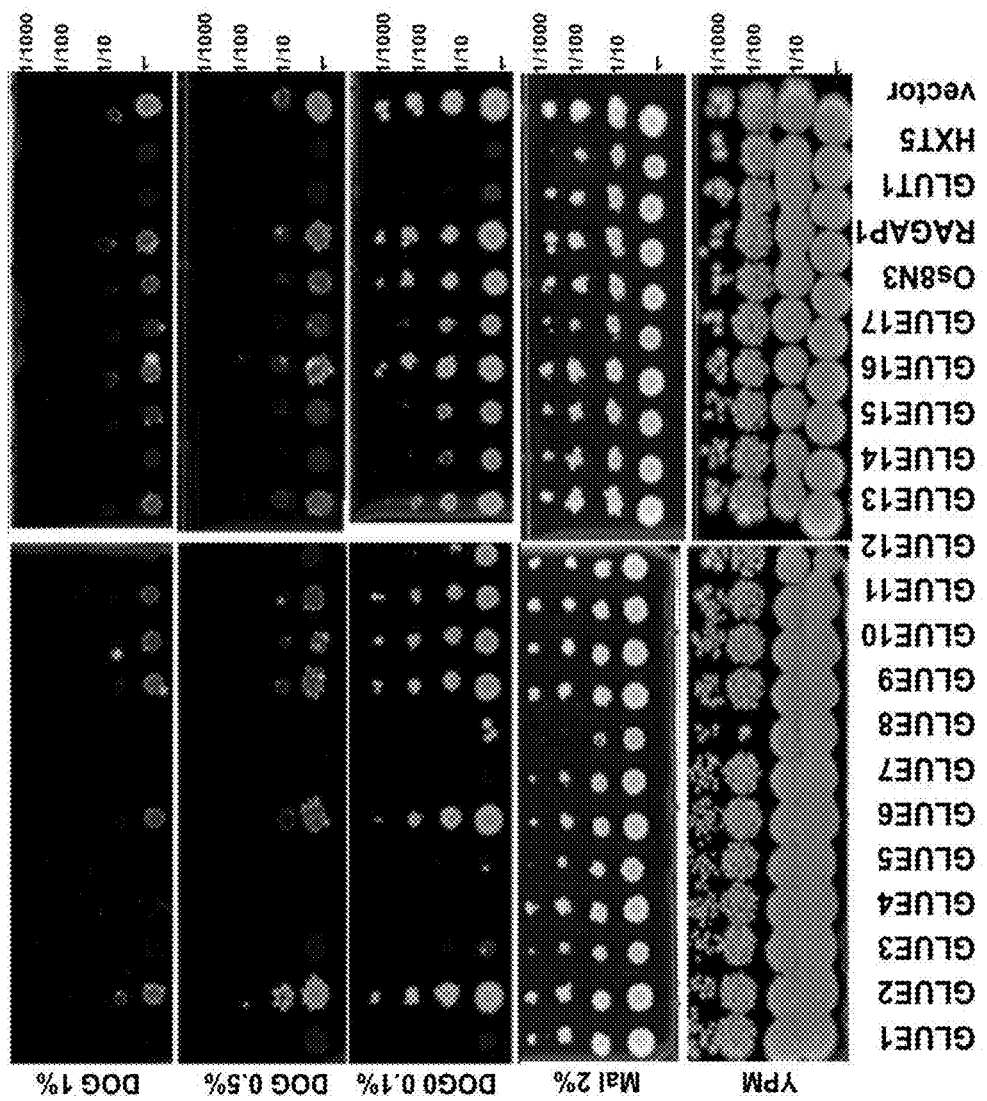
FIG. 23 shows complementation of yeast strain YSL2-1 lacking all 18 hexose transporter genes with 17 *Arabidopsis* GLUE genes. Cells expressing yeast homolog, HXT5, or mammalian homolog, GLUT1, were used as controls. Os8N3 and RAG1AP1 were homologs from rice and mammalian. The yeast cells were grown in SD-Ura liquid medium with 2% maltose to early log phase and 5 m of serious dilutions were spotted on the media containing YPM or SD-URA containing various 2-Deoxy-glucose levels. GLUE1, 3, 4, 5, 7, 8, 14, 16 and 17 transport 2-deoxyglucose since they are more sensitive to the sugar analog.
Figure 24:
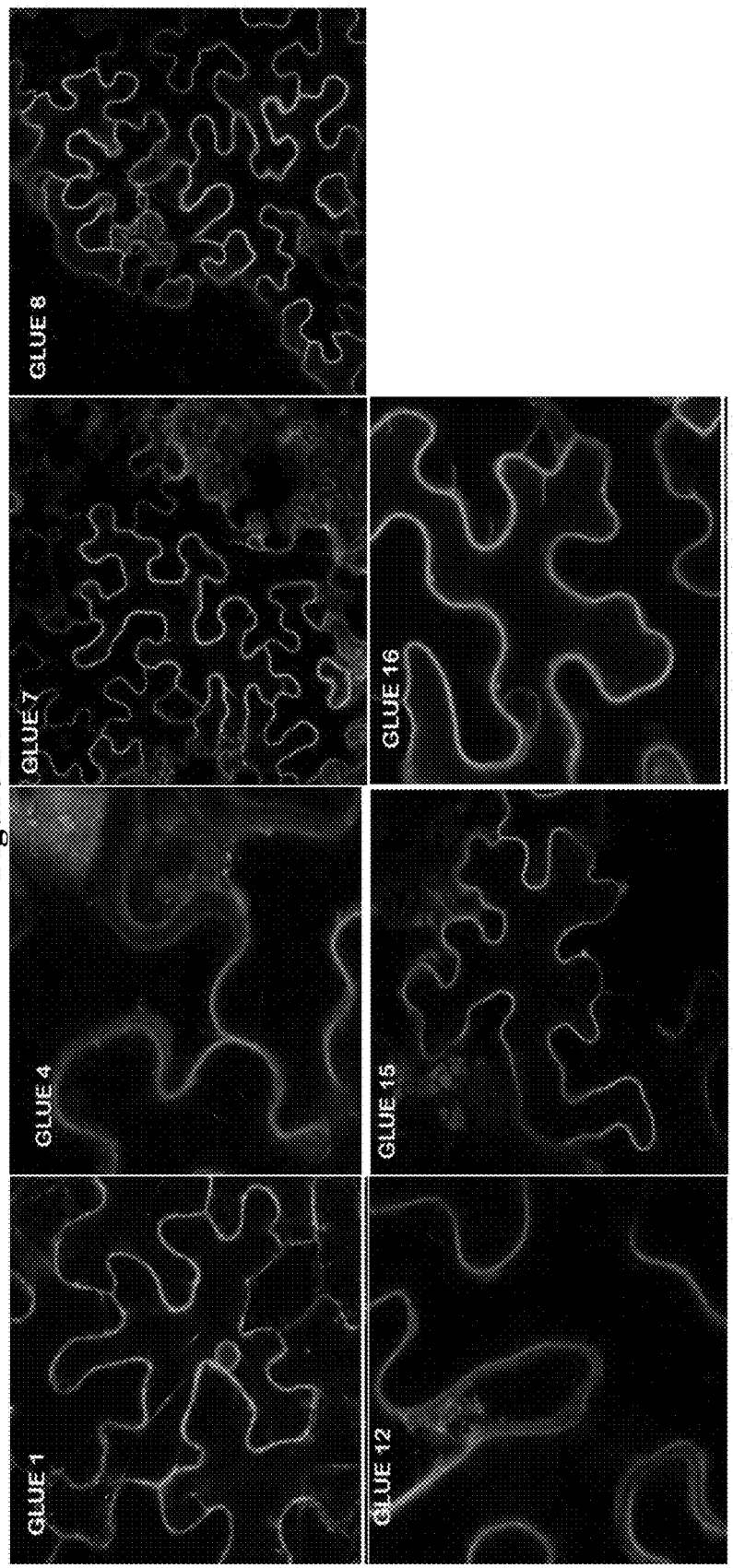
FIG. 24 shows subcellular localization of *Arabidopsis* GLUE protein in *planta*. GLUE-GFP fusion proteins localize close to or to the plasma membrane when transiently expressed in tobacco leaves.
Figure 25:
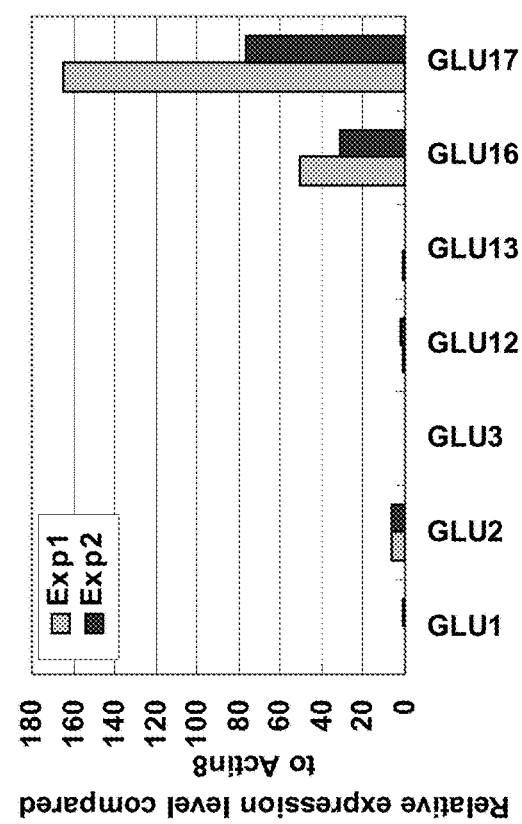
FIG. 25 shows GLUE expression in roots. qPCR analysis of GLUE gene expression in *Arabidopsis* roots. Transcripts were isolated from 10-day-old *Arabidopsis* seedlings and cDNA was generated as template. The relative expression levels were calculated using the comparative Ct method (1000*1/(2^(CtGIU-CtActin8)). Members of the family not shown here did not show significant expression levels (Guo et al., unpublished results). Data from four independent experiments.
Figure 26:
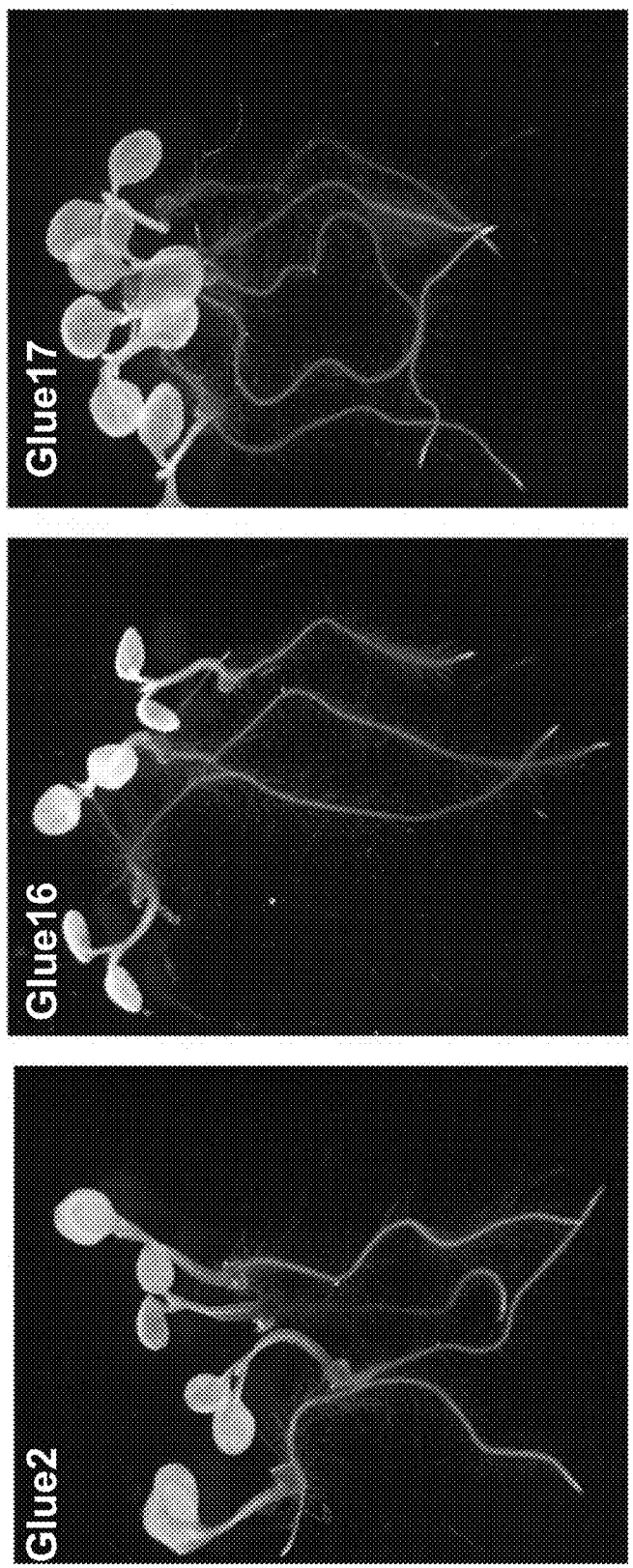
FIG. 26 shows histochemical analysis of expression patterns of Arabidopsis GLUE. GUS activity in transgenic Arabidopsis carrying the GLUE2, GLUE16, and GLUE17-GUS fusion proteins was analyzed by staining with X-gluc. Images are shown of whole plants from 10-d-old Arabidopsis seedlings.
Figure 27:
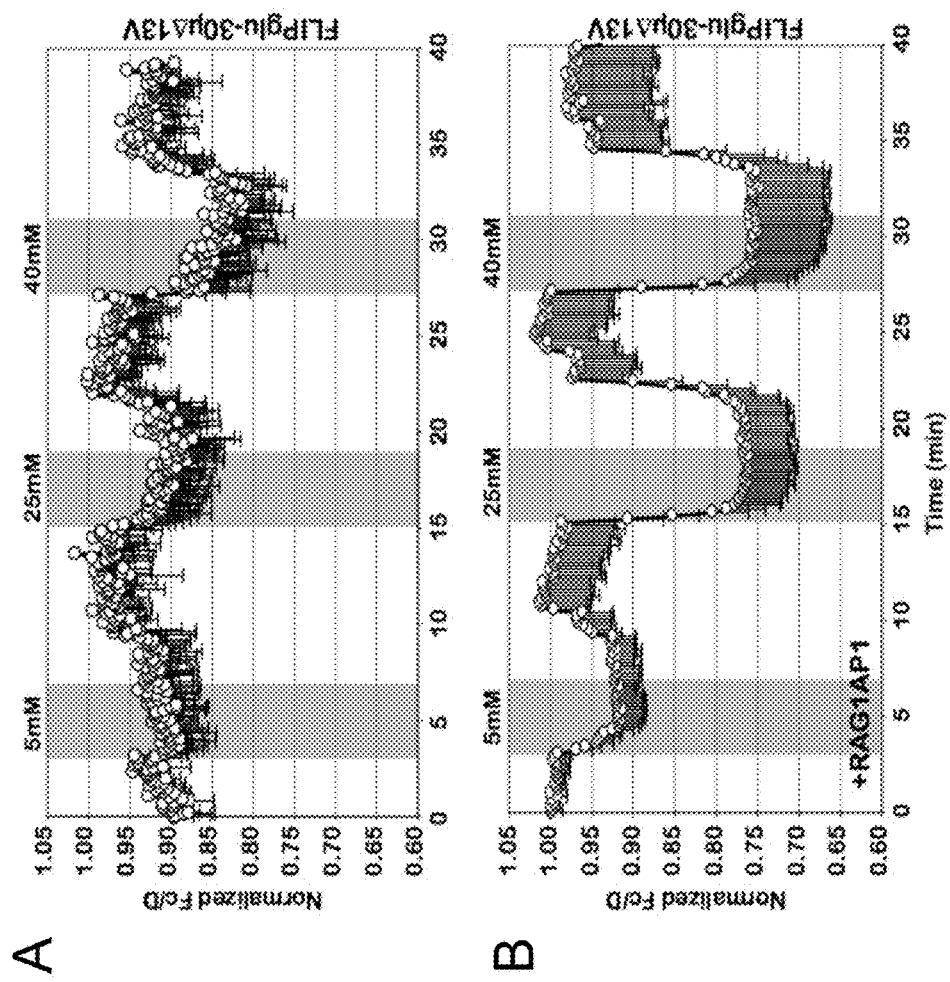
FIG. 27 shows sugar flux analysis in CIT3 cells with FRET glucose sensor. FRET analysis in CIT3 cell as a human mammary gland cell line, in the absence (A) or the presence (B) of co-expressing RAG1AP1-mCherry, with cytosolic FRET glucose sensor, FLIPglu-30μΔ13V. Cells were perfused with different external glucose concentrations (5, 25, and 40 mM). FRET images were acquired and data were analyzed. Data are mean±SD (n=7-9).
Figure 28:
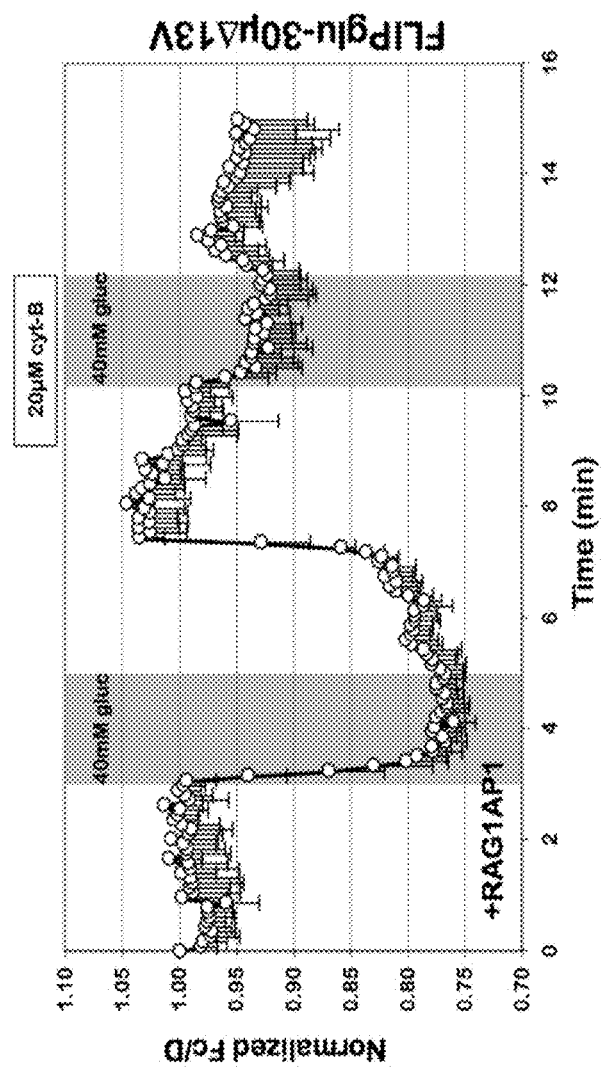
FIG. 28 shows the effect of Cytochalasin B on glucose level in CIT3 expressing RAG1AP1mCherry. FRET analysis in CIT3 cell as a human mammary gland cell line, in presence of co-expressing RAG1AP1-mCherry, with cytosolic FRET glucose sensor, FLIPglu-30μΔ13V. Cells were perfused with external 40 mM glucose in the presence or absence of 20 μM cytochalasin B. FRET images were acquired and data were analyzed. Data are mean±SD (n=5).
Figure 29:
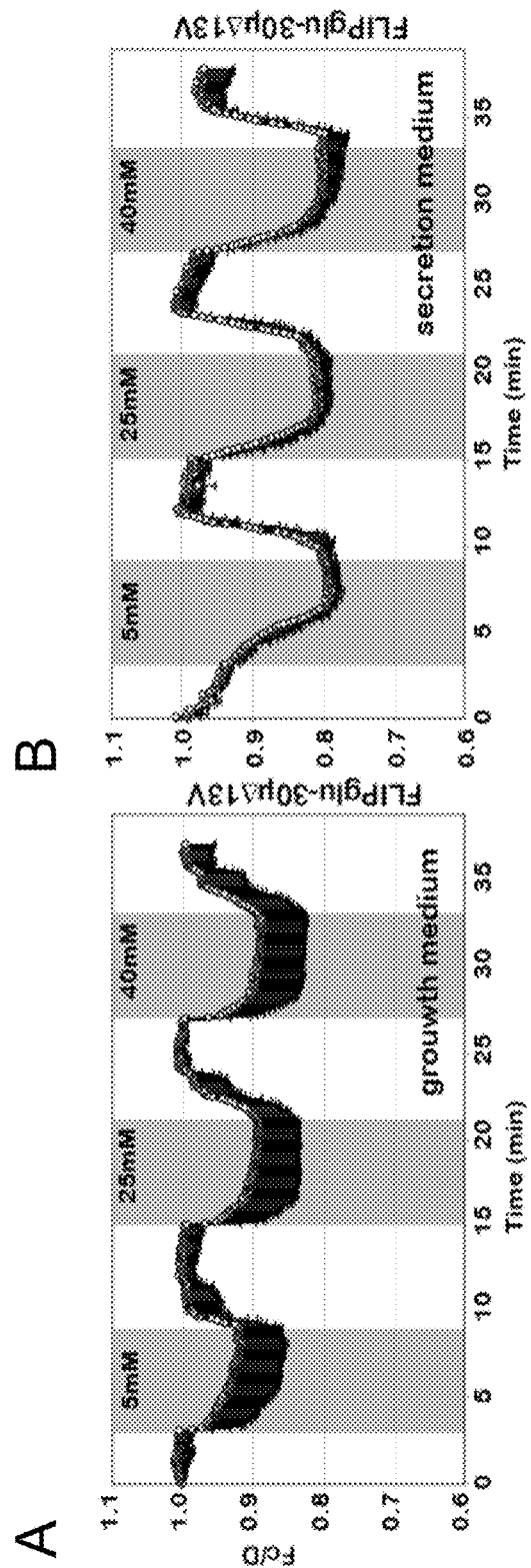
FIG. 29 shows the effect of differentiation on glucose level in CIT3 cells expressing RAG1AP1mCherry. FRET analysis in CIT3 cell as a human mammary gland cell line, in presence of co-expressing RAG1AP1-mCherry, with cytosolic FRET glucose sensor, FLIPglu-30μΔ13V. Cells were differentiated by 10 μg/mL insulin, 3 μg/mL prolactin and 3 μg/mL hydrocortisone (secretion medium). Cells were cultured in DMEM/F12 containing 10 μg/mL insulin and 5 ng/mL EGF (growth medium). Cells were perfused with external different glucose concentration (5, 25, and 40 mM). FRET images were acquired and data were analyzed. Data are mean±SD (n=11-13).
Figure 30:
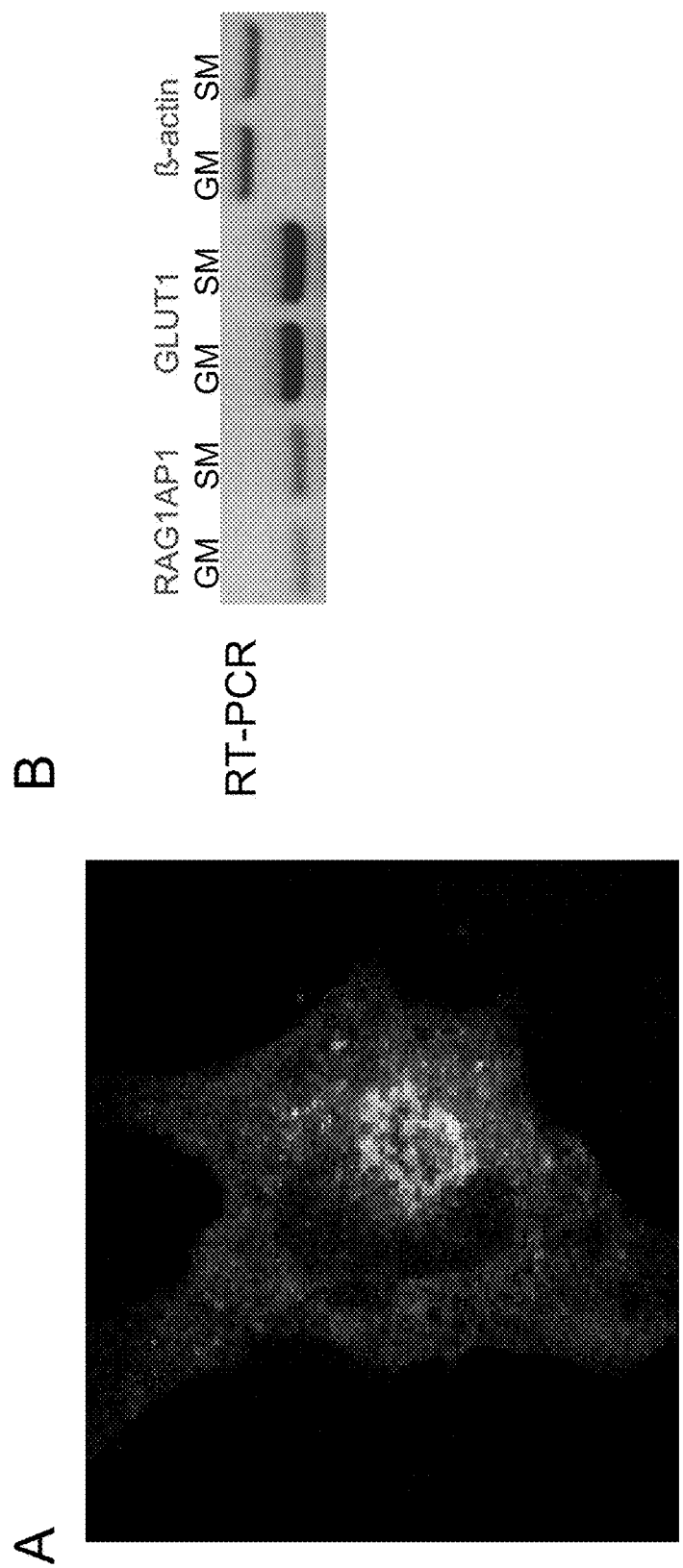
FIG. 30A shows the localization of RAG1AP1-GFP fusion protein in CIT3 cells. The image was taken by confocal microscopy.
FIG. 30B shows RT-PCR analysis of RNA from HepG2 cells and HEK293T cells. RAG1AP1, GLUT1 or β-actin were reverse transcribed and amplified by PCR. Non-differentiated or differentiated cells were cultured in GM (Growth medium), DMEM/F12 containing 10 μg/mL insulin and 5 ng/mL EGF or SM (secretion medium), DMEM/F12 containing 10 μg/mL insulin, 3 μg/mL prolactin and 3 μg/mL hydrocortisone.
Figure 31:
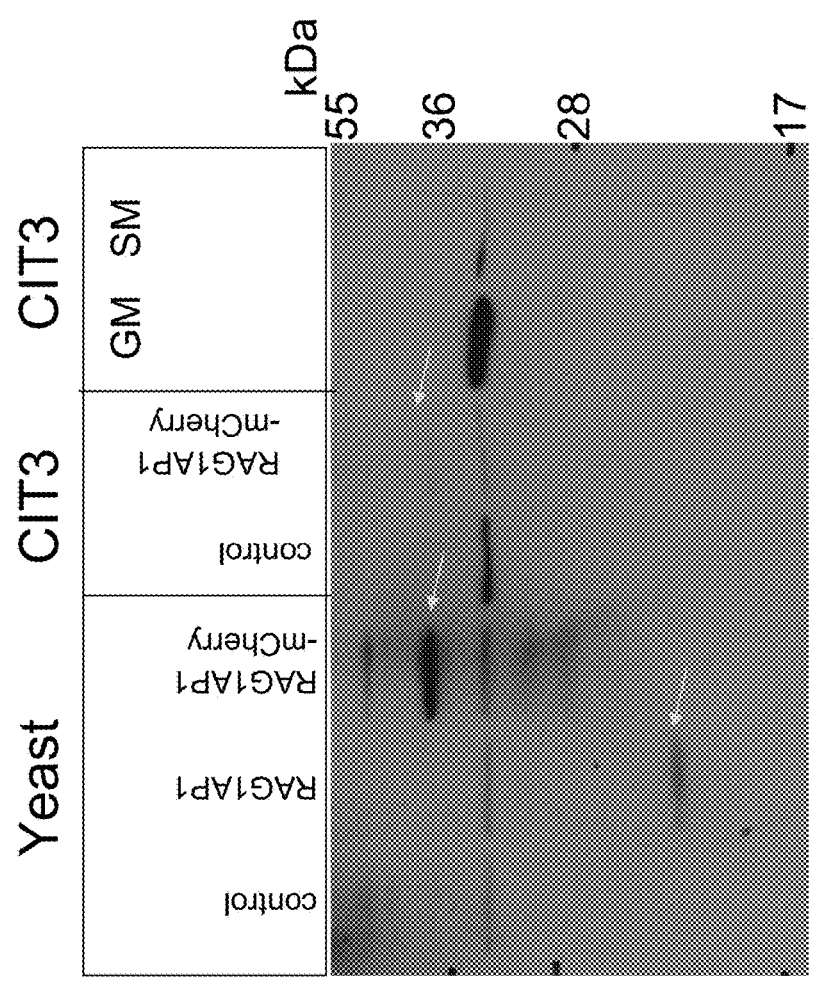
FIG. 31 shows a western blot of RAG1AP1 and RAG1AP1mCherry. Whole cell lysate of yeast, CIT3 with over-expressing RAG1AP1 or RAG1AP1-mCherry were separated by SDS-PAGE (12.5% gel). Antigen region is EQDRNYWLLQT (SEQ ID NO: 90), corresponding to C terminal amino acids 211-221 of human RAG1AP1 (Abcam).
Figure 32:
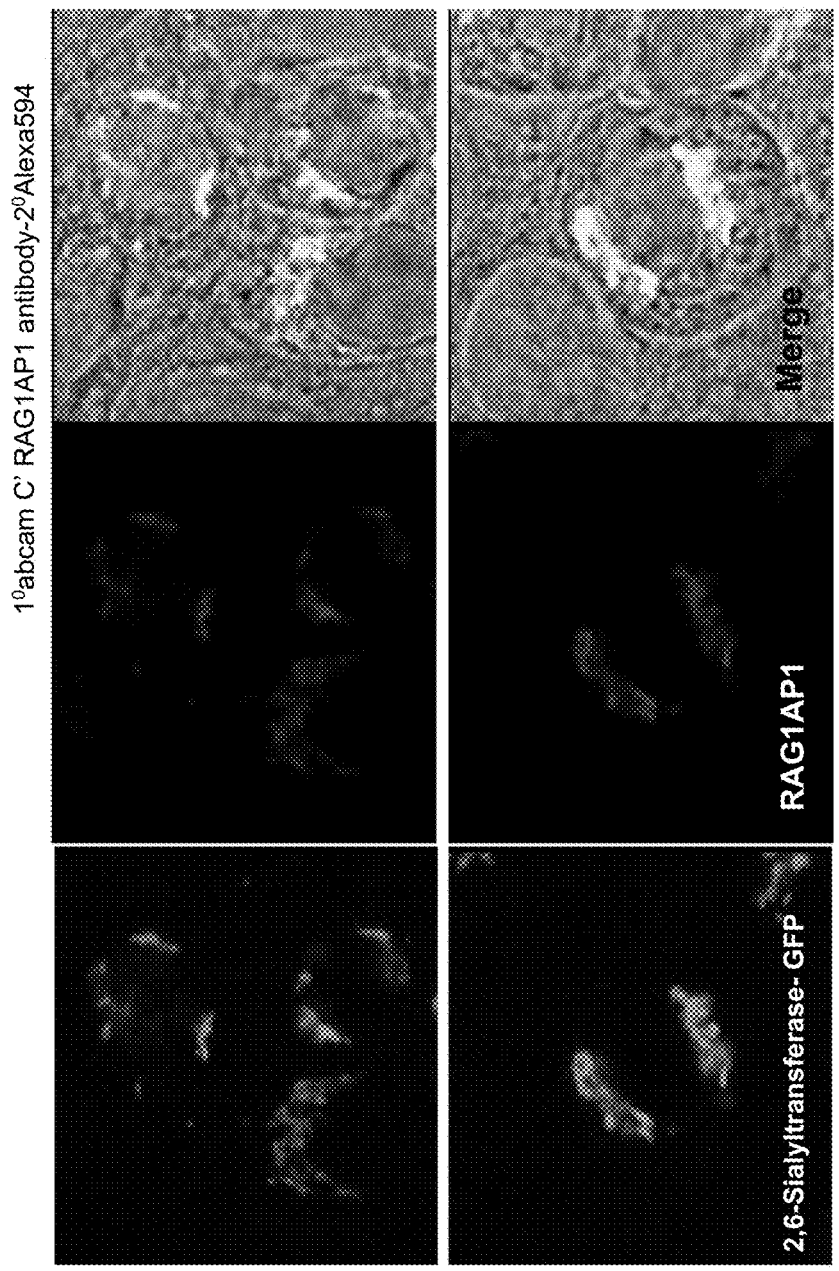
FIG. 32 shows immunofluorescence localization of RAG1AP1 in MDCK cells over-expressing RAG1AP1. RAG1AP1 was stained by antibody against the C-terminal peptide of human RAG1AP1 (Abcam) and Alexa 594-labeled donkey-anti-goat IgG. 2,6-Sialyltransferase-GFP (golgi marker) was merged to RAG1AP1.
Figure 33:
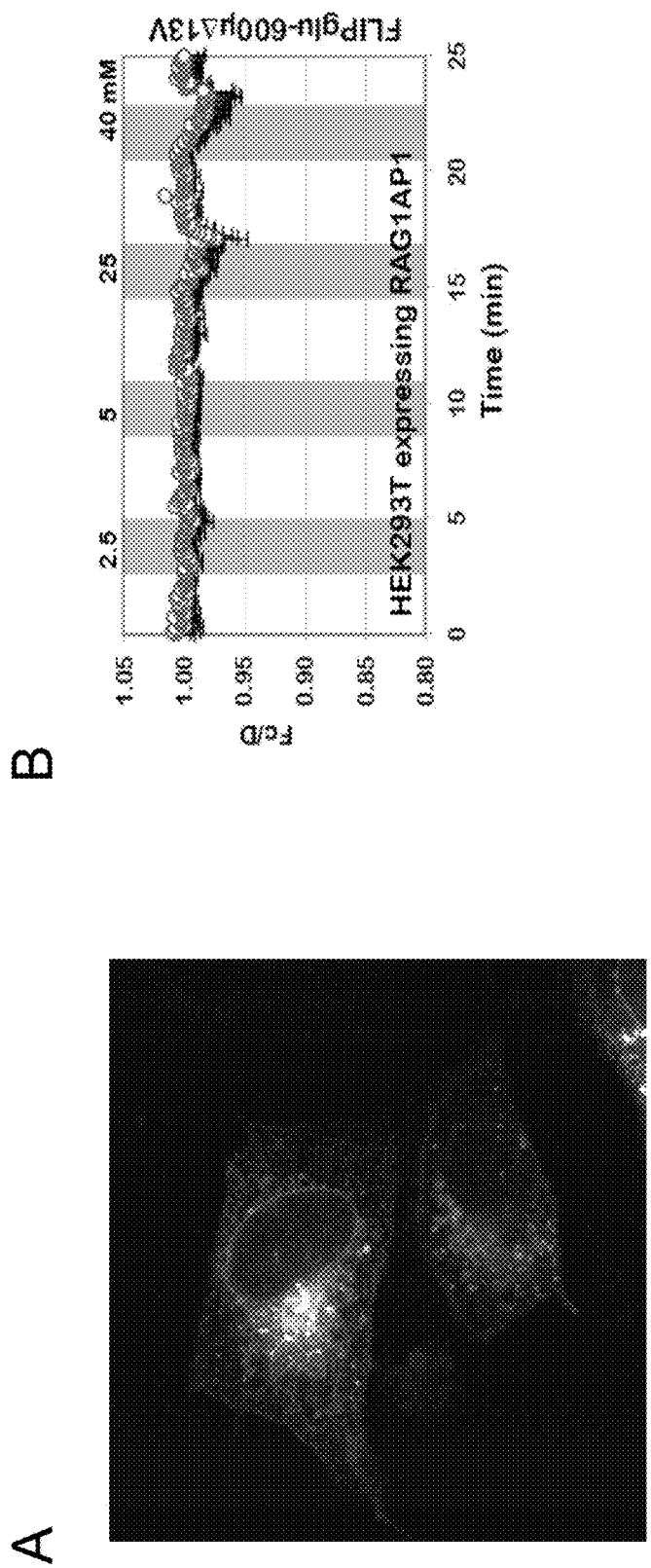
FIG. 33A shows localization of RAG1AP1-GFP fusion protein in MDCK cells. The image was taken by confocal microscopy.
FIG. 33B shows sugar flux analysis in HEK293T cells with FRET glucose sensor. FRET analysis in HEK293T cell expressing RAG1AP1 and co-expressing RAG1AP1-mCherry, with cytosolic FRET glucose sensor, FLIPglu-600μΔ13V. Cells were perfused with different external glucose concentrations (2.5, 5, 25, and 40 mM). FRET images were acquired and data were analyzed. Data are mean±SD (n=).
Figure 34:
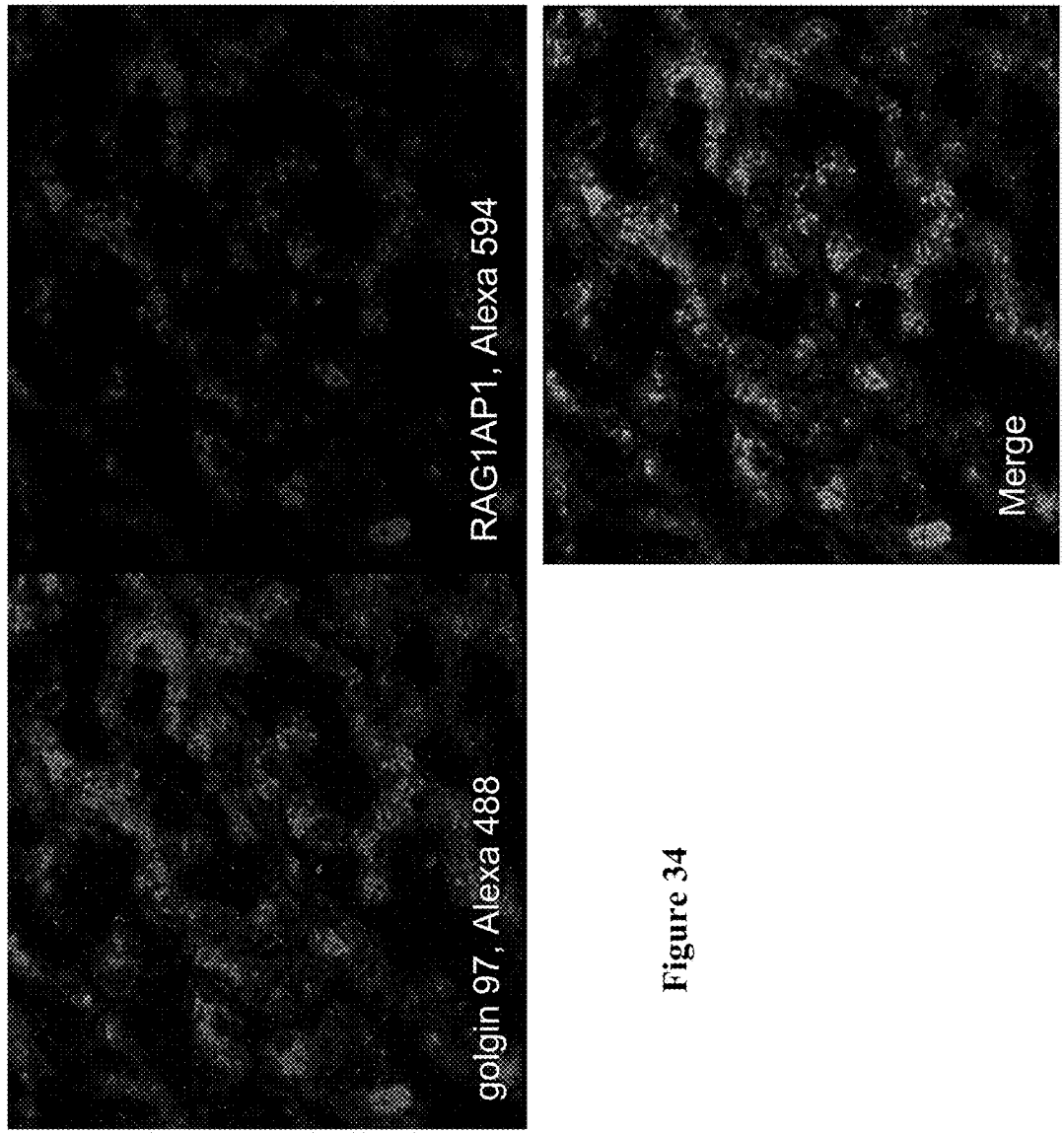
FIG. 34 shows immunofluorescence localization of RAG1AP1 in human liver sections. RAG1AP1 was stained by antibody against the C-terminal peptide of human RAG1AP1 (Abcam) and Alexa fluor 594-labeled donkey-anti-goat IgG. Golgin-97 was used as golgi-marker, which was stained by monoclonal antibody against golgin-97 (Invitrogen) and Alexa fluor 488-labeled donkey-anti-mouse IgG.
Figure 35:
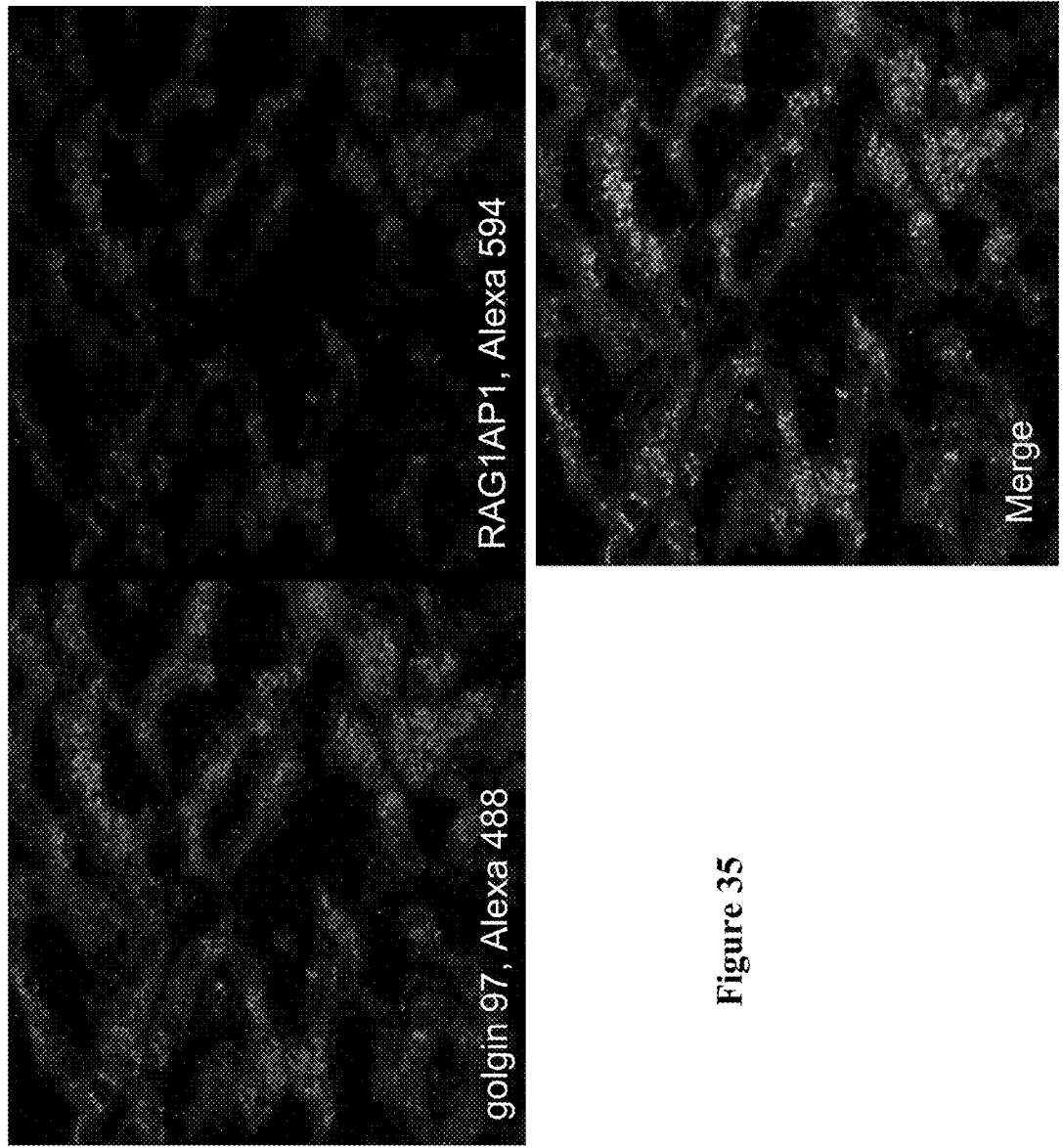
FIG. 35 shows immunofluorescence localization of RAG1AP1 in human liver sections. RAG1AP1 was stained by antibody against the C-terminal peptide of human RAG1AP1 (Abcam) and Alexa fluor 594-labeled donkey-anti-goat IgG. Golgin-97 was used as golgi-marker, which was stained by monoclonal antibody against golgin-97 (Invitrogen) and Alexa fluor 488-labeled donkey-anti-mouse IgG.
Figure 36:
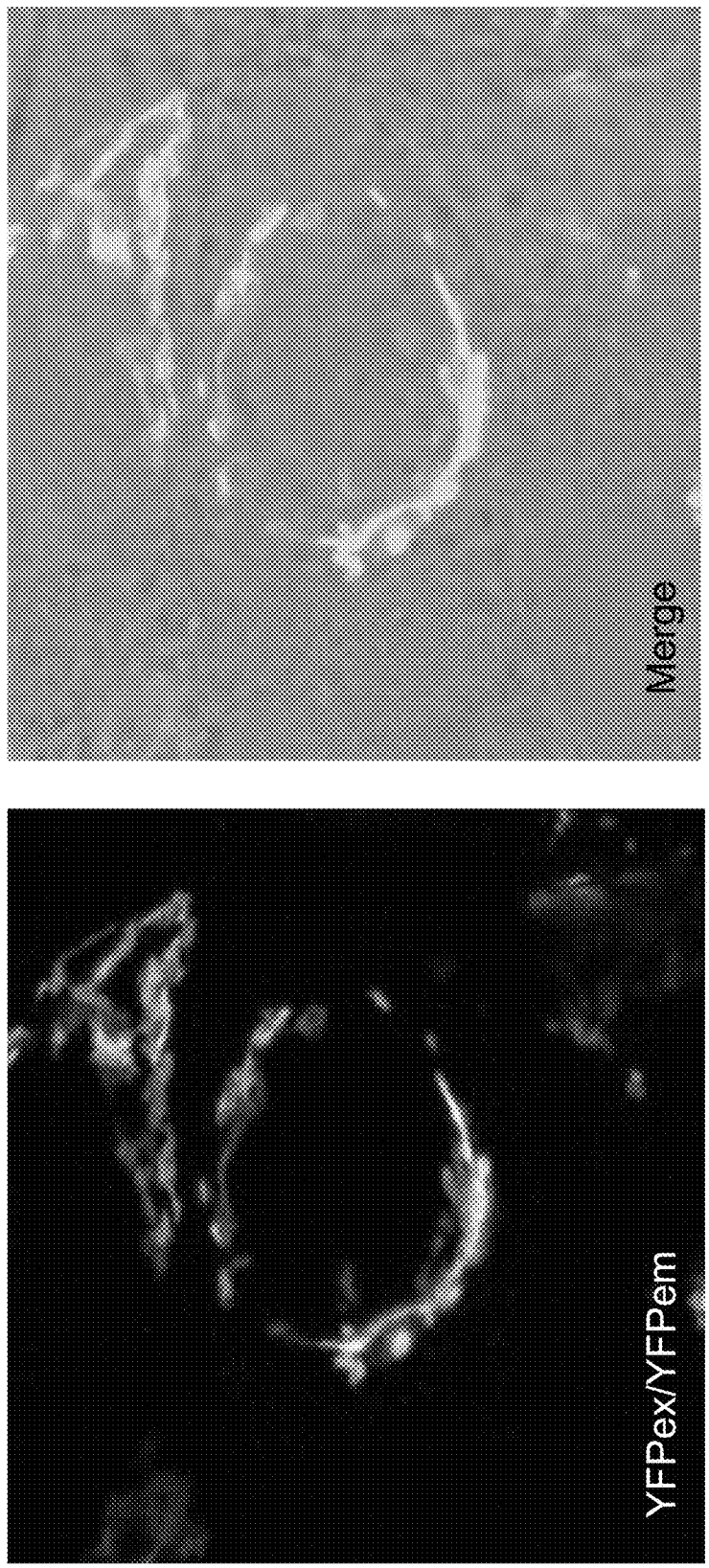
FIG. 36 shows Golgi-targeted FLIPglu-600μΔ13V. FRET glucose sensor was targeted to golgi using peptide (14-44) of β-1,4-galactosyltransferase I (galT) and stem (Schaub et al, Mol Biol Cell, 17: 5153-5162, 2006).
Figure 37:
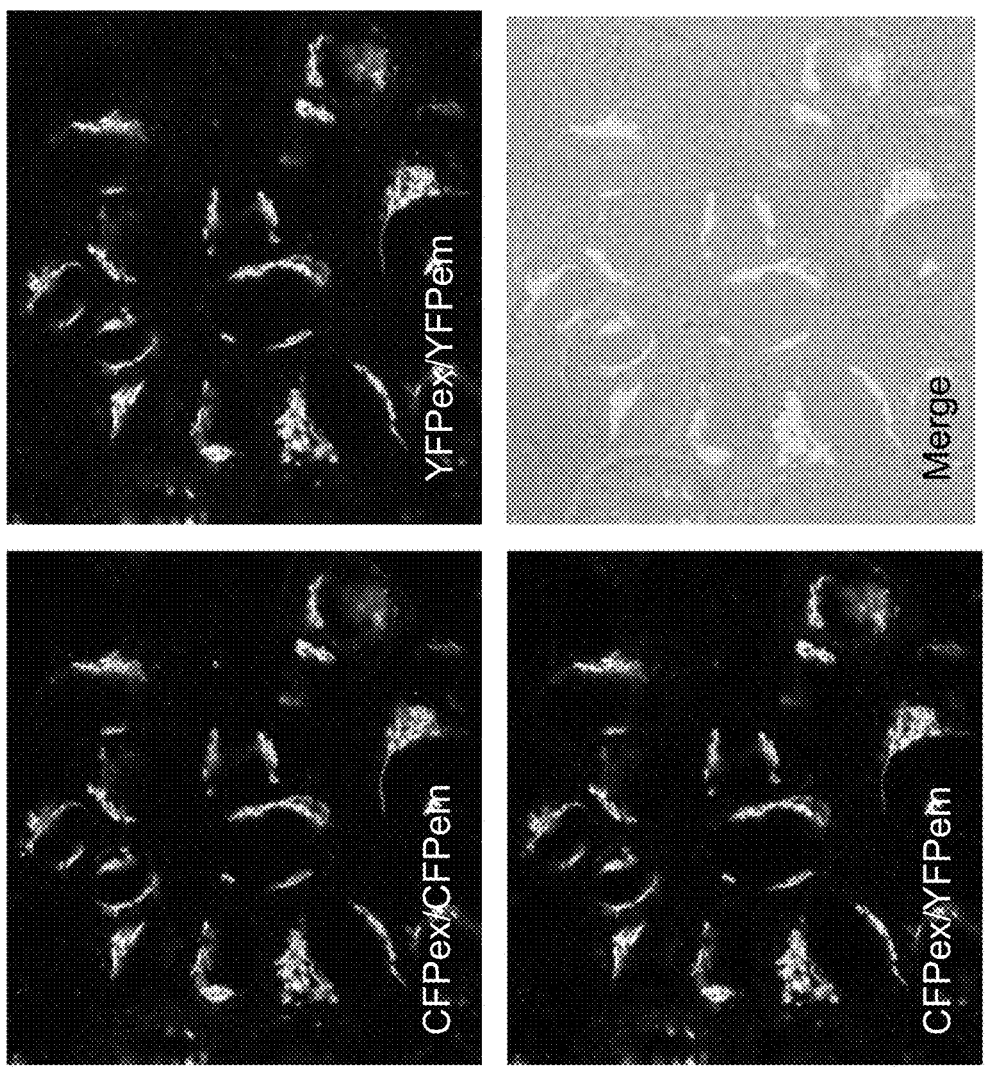
FIG. 37 shows Golgi-targeted FLIPglu-600μΔ13V. FRET glucose sensor was targeted to golgi using peptide (14-44) of β-1,4-galactosyltransferase I (galT) and stem (Schaub et al, Mol Biol Cell, 17: 5153-5162, 2006).
Figure 38:
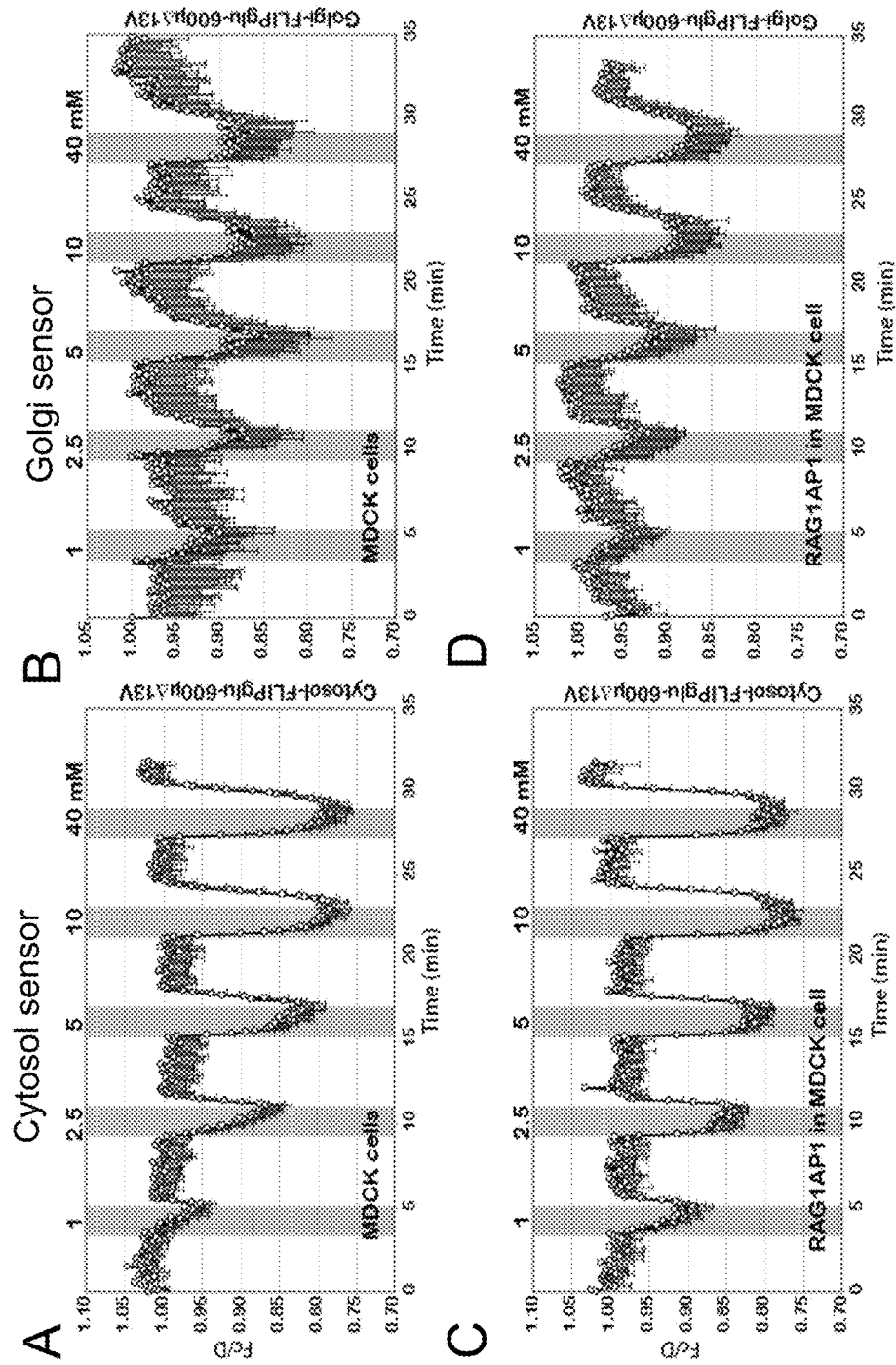
FIG. 38 shows sugar flux analysis in cytosolic and golgi of MDCK cells with FRET glucose sensor. FRET analysis in MDCK cell in the absence (A,B) or presence (C,D) of expressing RAG1AP1 and co-expressing with cytosolic (A,C) or golgi targeted (B,D), FRET glucose sensor FLIPglu-600μΔ13V. Cells were perfused with different external glucose concentrations (1, 2.5, 5, 10, and 40 mM). FRET images were acquired and data were analyzed. Data are mean±SD (n=4-15).
Figure 39:
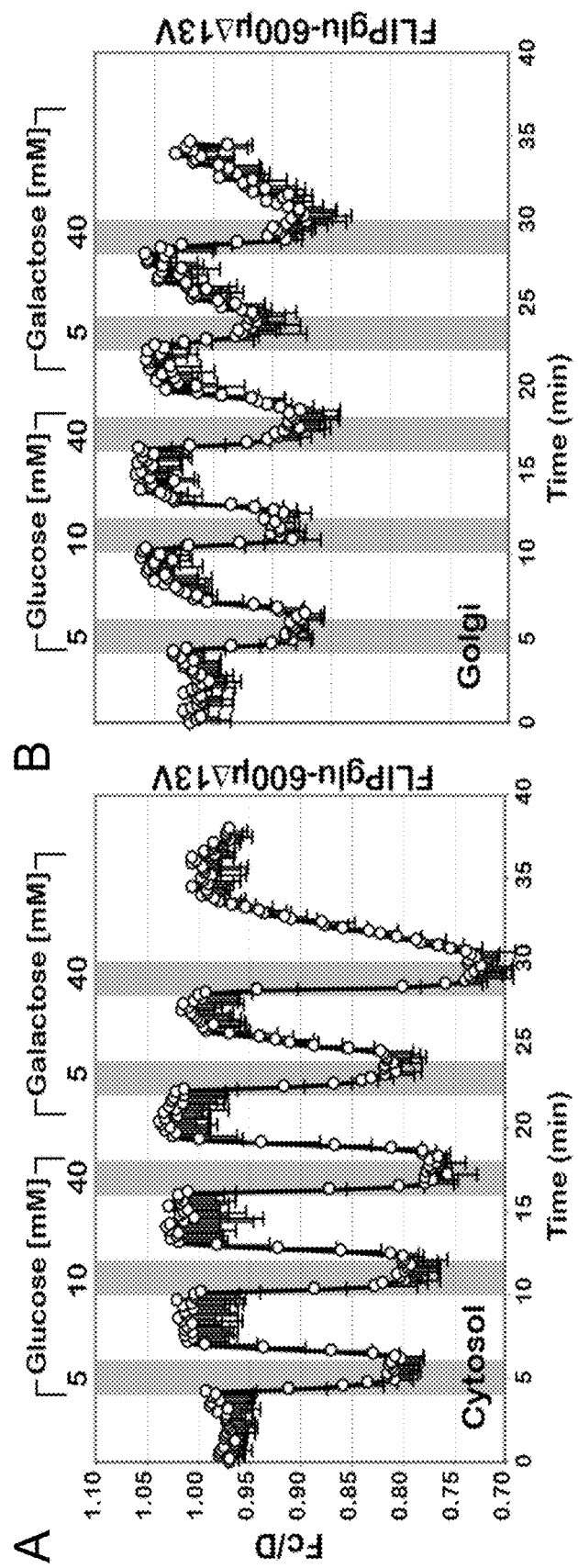
FIG. 39 shows sugar flux analysis in cytosolic and golgi of Hela cells with FRET glucose sensor. FRET analysis in Hela cell expressing cytosolic (A) or golgi targeted (B), FRET glucose sensor FLIPglu-600μΔ13V. Cells were perfused with different external glucose concentrations (5, 10, and 40 mM) and galactose (5 and 40 mM). FRET images were acquired and data were analyzed. Data are mean±SD (n=7-8).
Figure 40:
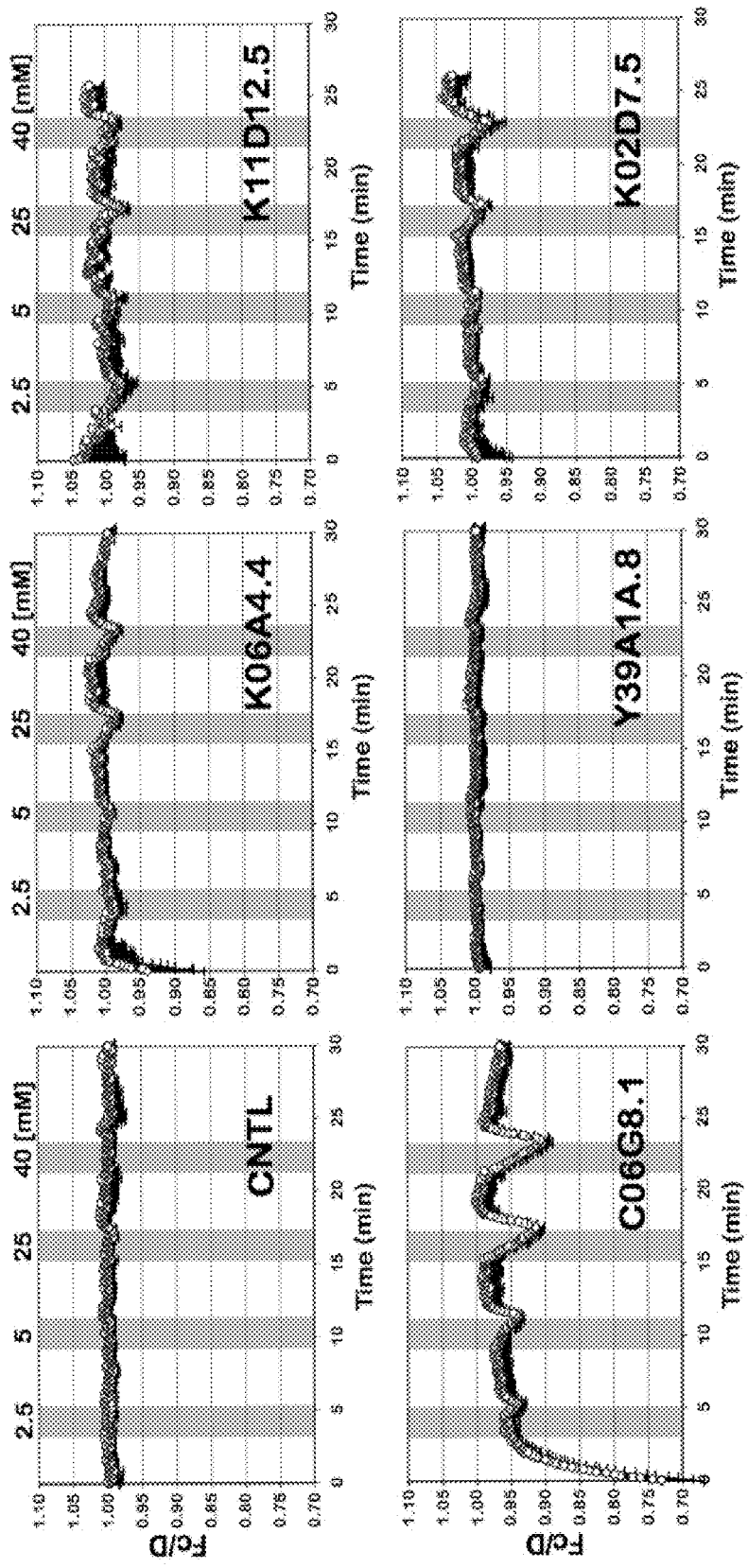
FIG. 40 shows sugar flux analysis in HEK293T cells expressing C. elegans GLUE family members with FRET glucose sensor. FRET analysis in HEK293T cells expressing C. elegans GLUE members coexpressing with FRET glucose sensor, FLIPglu-600μΔ13V. Cells were perfused with different external glucose concentrations (2.5, 5, 10, and 40 mM) and galactose (5 and 40 mM). FRET images were acquired and data were analyzed. Data are mean±SD (n=12-24).
Figure 41:
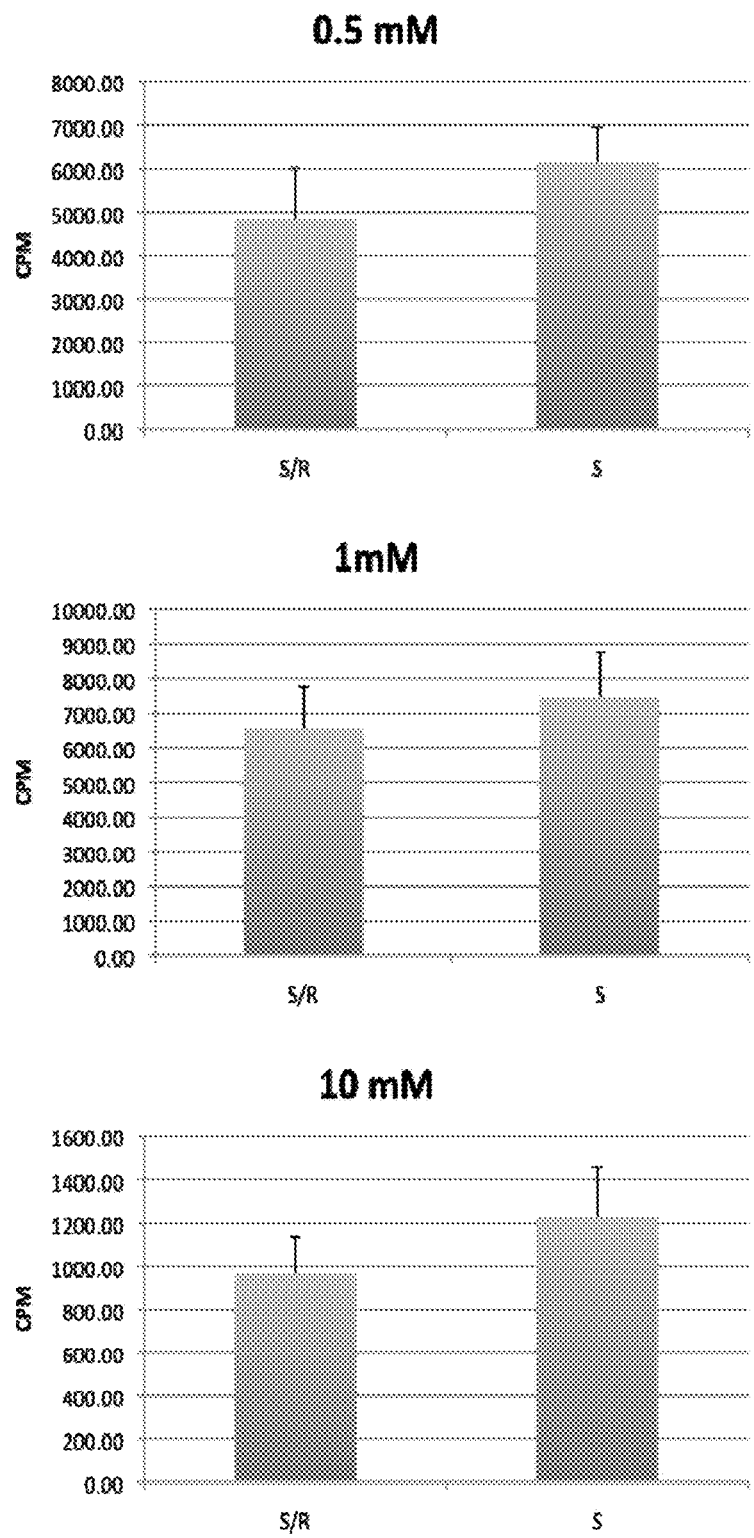
FIG. 41 shows that the human RAG1AP1 homolog is a sugar efflux transporter. Human SGLT1 sodium glucose cotransporter ("S") which has been previously shown to be a secondary active glucose importer. SGLT1 is endogenously expressed in Xenopus oocytes and can mediate uptake of 14C labelled glucose into the oocyte. When RAG1AP1 ("R") is coexpressed, less uptake is seen in the oocytes. This is compatible with a glucose 'leak' due to RAG1AP1 activity that prevents high accumulation of glucose in the SGLT1 expressing cells.
Figure 42:
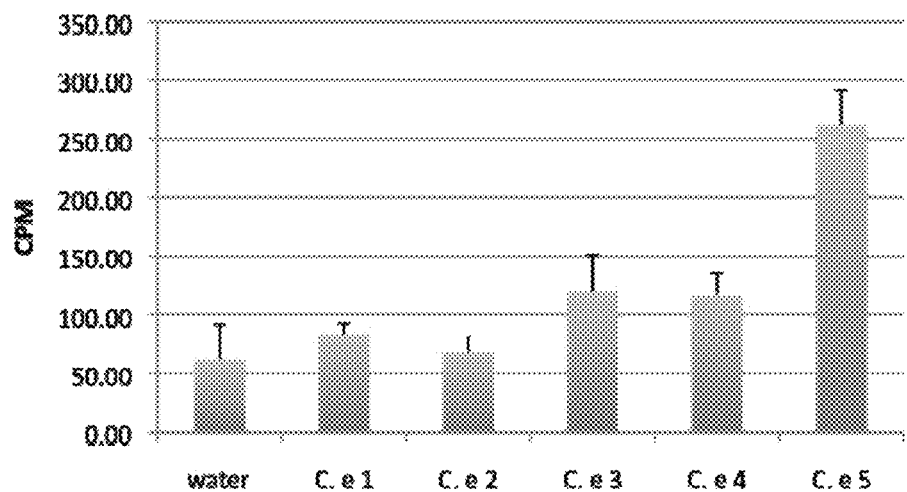
FIG. 42 shows the 14C glucose uptake data for five of the C. elegans homologs. At least 3, 4 and 5 are active. (code for names of *C elegans* genes: Ce1: C06G8.1; Ce2: K06A4.4; Ce3: Y39A1A.8; Ce4: K11D12.5; Ce5: K02D7.5; (worm mutants of Ce5: K02D7.5 show increased fat accumulation, consistent with reduced efflux of glucose from these cells).
Figure 42:
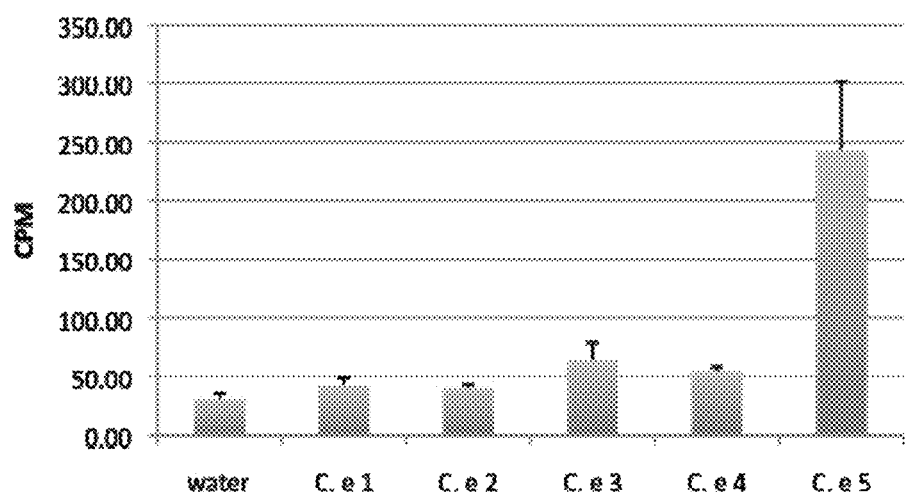

The human genome contains at least two classes of glucose transporters, SLC2 and SLC5. SLC2, named GLUTs are uniporters, i.e. they transport glucose along its concentration gradient. In contrast, SGLTs are Na$^+$-coupled cotransporters that can actively import glucose driven by a sodium gradient. These transporters can explain most of the uptake activities found in humans, e.g. a GLUT2 mouse knock-out mutant shows dramatically reduced uptake capacity. However, surprisingly, glucose clearance was normal, suggesting the existence of an alternative efflux route. The use of a FRET sensor based expression cloning system lead to the identification of a novel class of glucose transporters in plants (accompanying ms). *Arabidopsis* SWEET1 and 8 function as uniporters, while the rice OsSWEET11 appears to efflux glucose and sucrose. Bioinformatic analyses showed that animals and human genomes contain homologs, registered as solute carrier family SLC50 (www.biopara-digms.org/slc/intro.htm) (FIG. 1). Here we show that the *C. elegans* CeSWEET1 mediates weak, but significant glucose uptake when expressed in *Xenopus* oocytes (FIG. 19B). The activity is significantly weaker than that of SGLT1 or the plant homolog SWEET1. In comparison, the *C. elegans* homologs CeSWEET3, 4, 5 and 7 did not mediate detectable glucose uptake in oocytes (FIG. 19B). The plant homolog OsSWEET11, which effluxes glucose and sucrose, had been shown to counteract SGLT1-mediated glucose accumulation in oocytes when coexpressing both proteins. The working hypothesis is that OsSWEET11-mediated efflux acts as a 'leak', preventing accumulation of glucose in the oocyte (3). To test whether the *C. elegans* homologs may potentially function as effluxers, we coexpressed them with SGLT1 (FIG. 19C). All five homologs tested lead to reduced glucose accumulation as compared to SGLT1 alone. Direct efflux measurements from oocytes injected with [$^{14}$C]-glucose show that RAP1AP1 induces efflux of glucose from oocytes (% glucose released within 2 min: RAG1AP1: 5.27±0.29; control: 0.91±0.23; S.E.; n>7). Mutations in one of the *C. elegans* homologs (CeSWEET1; K02D7.5) leads to fat accumulation, consistent with a lack in the ability to efflux sugars. Similar to CeSWEET3, 4, 5 and 7, the human homolog RAG1AP1 (renamed HsSWEET1) was also unable to mediate glucose accumulation in oocytes, but counteracted SGLT1-mediated glucose accumulation. This was true for the two splice variants and a mutated version carrying three mutations in three residues forming putative internalization motifs (FIG. 19C). Mutations in the homolog Ci-Rga (CiSWEET1) from the sea squirt *Ciona* lead to early developmental defects, underlining the importance of these genes for metazoa. In mammals, at least one of the glucose efflux routes from liver has remained elusive.

RAG1AP1 had been named Recombination Activating Gene 1 Activating Protein 1 since a defect in a cell line affected recombination. Moreover, the gene has been named RGA and has been implied in targeting of TRPV ion channels. It will be interesting to test the hypothesis that RAG1AP1 may contribute to glucose efflux in liver.

Example 8

SWEET Sucrose Exportation in HEK293 Cells

SWEETs 1-4 and 6-11 and 14-16 were expressed in HEK293 with a FRET sucrose sensor. Several members of the SWEET family exported sucrose. The SWEET members that demonstrated this ability all belong to the same clade (see FIG. 1). Accordingly, this clade appears to demonstrate a strong ability to export sucrose. OsSWEET11 belongs to that clade, thus besides exporting glucose, these proteins also export sucrose. This may be significant in targeting pathogens like Ustilago that take up sucrose. It has been reported that a novel high-affinity sucrose transporter is required for virulence of the plant pathogen *Ustilago maydis*. PLoS Biol. 8(2):e1000303) or cell wall invertase then cleaves sucrose and the pathogen imports glucose.

The demonstrated ability of SWEETs to export sucrose is important as it has long been known that sucrose effluxers are required for cell to cell transport in leaves, but the identity of these proteins has remained elusive. As SUTs take up sucrose from the cell wall, somewhere in the leaf, sucrose produced in mesophyll cells has to efflux into the cell wall. The ability of SWEETs to export sucrose accordingly provides significant data in understanding how plants achieve this. Moreover, the maternal tissue of a plant must export sucrose to supply developing seeds with sucrose as the main transported sugar in the plant. Thus, the role of SWEETs as sucrose exporters may be significant in developing seeds.

All publications and patent applications herein are incorporated by reference to the same extent as if each individual publication or patent application was specifically and individually indicated to be incorporated by reference. The publications discussed herein are provided solely for their disclosure prior to the filing date of the present application. Nothing herein is to be construed as an admission that the present invention is not entitled to antedate such publication by virtue of prior invention.

SEQUENCE LISTING (159 sequences)

SEQ ID NO: 1 - protein, 241 aa, Arabidopsis thaliana
MAEASFYIGVIGNVISVLVFLSPVETFWKIVKRRSTEEYKSLPYICTLLGSSLWTYYGIVTPGEYLVSTVNGFGALVETIYVSLFLFYAPRHLKLKTVDVDAMLNVFFPIAAIVATRSAFEDEKMRSQSIGFISAGLNIIMYGSPLSAMKTVVTTKSVKYMPFWLSFFLFLNGAIWAVYALLQHDVFLLVPNGVGFVFGTMQLILYGIYRNAKPVGLSNGLSEIAQDEEEGLTSRVEPLLS

SEQ ID NO: 2 - protein, 230 aa, Arabidopsis thaliana
MADLSFYVGVIGNVISVLVFLSPVETFWRIVQRRSTEEYECFPYICTLMSSSLWTYYGIVTPGEYLVSTVNGFGALAESIYVLIFLFFVPKSRFLKTVVVVLALNVCFPVIAIAGTRTLFGDANSRSSSMGFICATLNIIMYGSPLSAIKTVVTTRSVQFMPFWLSFFLFLNGAIWGVYALLLHDMFLLVPNGMGFFLGIMQLLIYAYYRNAEPIVEDEEGLIPNQPLLA

SEQ ID NO: 3 - protein, 292 aa, Arabidopsis thaliana
MGVMINHHFLAFIFGILGNVISFLVFLAPVPTFYRIYKRKSTESFQSLPYQVSLFSCMLWLYYALIKKDAFLLITINSFGCVVETLYIAMFFAYATREKRISAMKLFIAMNVAFFSLILMVTHFVVKTPPLQVSVLGWICVAISVSVFAAPLMIVARVIKTKSVEYMPFTLSFFLTISAVMWFAYGLFLNDICIAIPNVVGFVLGLLQMVLYLVYRNSNEKPEKINSSEQQLKSIVVMSPLGVSEVHPVVTESVDPLSEAVHHEDLSKVTKVEEPSIENGKCYVEATRPETV

SEQ ID NO: 4 - DNA, 879 bp, Arabidopsis thaliana
atgggagtcatgatcaatcaccatttcctcgcttttatcttcggcatcttaggaaacgtgatatccttccttgtattcctcgctccagtgccaactttttatagaatatacaagagaaaatcgacggaaagtttccagtcgctaccgtaccaagtgtcgctatttagctgcatgctatggctctactacgcattgattaagaaagacgcttttctcctaattaccatcaactcctttggctgcgtcgtggagactctctacatagccatgttcttcgcttacgccaccagggagaaaaggatatcggctatgaagttgttcatagcaatgaacgttgccttcttctcgttgattctaatggtaacacatttcgtggttaaaactcctcccctccaagtctctgtactcggctggatttgtgttgccatttctgtttctgttttcgctgcccctctaatgatcgtggctcgtgtgataaagacaaagagtgtggagtacatgcccttcacgctttctttcttcctcactataagcgccgttatgtggttcgcttatggtttattcctcaatgacatatgcatagcgattccaaacgtggtgggattcgtactagggctgttgcaaatggttttgtacttggtttacaggaactcaaatgagaaaccagagaagattaattcgtcagaacaacaacttaagagtattgtcgtgatgagtccgttaggtgtgtcggaagtgcacccagttgtgacggaatcggtggacccactctctgaagccgttcatcatgaggatctgtccaaagttactaaagtggaggagccgtcaattgaaaacggcaagtgctacgtggaggctactcgtcctgaaaccgtttga

SEQ ID NO: 5 - protein, 281 aa, Arabidopsis thaliana
MVLTHNVLAVTFGVLGNIISFIVFLAPVPTFVRICKKKSIEGFESLPYVSALFSAMLWIYYALQKDGAGFLLITINAVGCFIETIYIILFITYANKKARISTLKVLGLLNFLGFAAIILVCELLTKGSNREKVLGGICVGFSVCVFAAPLSIMRVVIRTKSVEFMPFSLSLFLTISAITWLFYGLAIKDFYVALPNILGAFLGAVQMILYVIFKYYKTPLVVDETEKPKTVSDHSINMVKLSSTPASGDLTVQPQTNPDVSHPIKTHGGDLEDQMDKKMPN

SEQ ID NO: 6 - protein, 294 aa, Arabidopsis thaliana
MALTNNLWAFVFGILGNIISFVVFLAPVPTFVRICKKKSTEGFQSLPYVSALFSAMLWIYYAMQKDGTAFLLITINAFGCVIETIYIVLFVSYANKKTRISTLKVLGLLNFLGFAAIVLVCELLTKGSTREKVLGGICVGFSVSVFAAPLSIMRVVVRTRSVEFMPFSLSLFLTISAVTWLFYGLAIKDFYVALPNVLGAFLGAVQMILYIIFKYYKTPVAQKTDKSKDVSDHSIDIAKLTTVIPGAVLDSAVHQPPALHNVPETKIQLTEVKSQNMTDPKDQINKDVQKQSQV

SEQ ID NO: 7 - protein, 285 aa, Arabidopsis thaliana
MALFDTHNTWAFVFGLLGNLISFAVFLSPVPTFYRICKKKTTEGFQSIPYVVALFSAMLWLYYATQKKDVFLLVTINSFGCFIETIYISIFVAFASKKARMLTVKLLLLMNFGGFCLILLLCQFLAKGTTRAKIIGGICVGFSVCVFAAPLSIIRTVIKTKSVEYMPFSLSLTLTISAVIWLLYGLALKDIYVAFPNVIGFVLGALQMILYVVYKYCKTPSDLVEKELEAAKLPEVSIDMVKLGTLTSPEPVAITVVRSVNTCNCNDRNAEIENGQGVRNSAATT

SEQ ID NO: 8 - protein, 289 aa, Arabidopsis thaliana
MSLFNTENTWAFVFGLLGNLISFAVFLSPVPTFYRIWKKKTTEGFQSIPYVVALFSATLWLYYATQKKDVFLLVTINAFGCFIETIYISMFLAYAPKPARMLTVKMLLLMNFGGFCAILLLCQFLVKGATRAKIIGGICVGFSVCVFAAPLSIIRTVIKTRSVEYMPFSLSLTLTISAVIWLLYGLALKDIYVAFPNVLGFALGALQMILYVVYKYCKTSPHLGEKEVEAAKLPEVSLDMLKLGTVSSPEPISVVRQANKCTCGNDRRAEIEDGQTPKHGKQSSSAAAT

SEQ ID NO: 9 - protein, 289 aa, Arabidopsis thaliana
MAISQAVLATVFGILGNIISFFVCLAPIPTFVRIYKRKSSEGYQSIPYVISLFSAMLWMYYAMIKKDAMMLITINSFAFVVQIVYISLFFFYAPKKEKTLTVKFVLFVDVLGFGAIFVLTYFIIHANKRVQVLGYICMVFALSVFVAPLGIIRKVIKTKSAEFMPFGLSFFLTLSAVMWFFYGLLLKDMNIALPNVLGFIFGVLQMILFLIYKKPGTKVLEPPGIKLQDISEHVVDVVRLSTMVCNSQMRTLVPQDSADMEATIDIDEKIKGDIEKNKDEKEVFLISKN

SEQ ID NO: 10 - protein, 258 aa, Arabidopsis thaliana
MFLKVHEIAFLFGLLGNIVSFGVFLSPVPTFYGIYKKKSSKGFQSIPYICALASATLLLYYGIMKTHAYLIISINTFGCFIEISYLFLYILYAPREAKISTLKLIVICNIGGLGLLILLVNLLVPKQHRVSTVGWVCAAYSLAVFASPLSVMRKVIKTKSVEYMPFLLSLSLTLNAVMWFFYGLLIKDKFIAMPNILGFLFGVAQMILYMMYQGSTKTDLPTENQLANKTDVNEVPIVAVELPDVGSDNVEGSVRPMK

SEQ ID NO: 11 - protein, 239 aa, Arabidopsis thaliana
MVDAKQVRFIIGVIGNVISFGLFAAPAKTFWRIFKKKSVEEFSYVPYVATVMNCMLWVFYGLPVVHKDSILVSTINGVGLVIELFYVGVYLMYCGHKKNHRRNILGFLALEVILVVAIILITLFALKGDFVKQTFVGVICDVFNIAMYGAPSLAIIKVVKTKSVEYMPFLLSLVCFVNAGIWTTYSLIFKIDYYVLASNGIGTFLALSQLIVYFMYYKSTPKEKTVKPSEVEISATERV

SEQ ID NO: 12 - DNA, 720 bp, Arabidopsis thaliana
atggttgatgcaaaacaagttcgtttcatcatcggagttatcggaaatgttatctcctttggtctctttgccgcaccagcgaagactttctggaggatcttcaagaagaaatcagtggaagagttttcgtatgtgccgtacgtagcaacggtgatgaattgtatgttgtgggtgttttacggtctccctgtggttcacaaagacagtattctagtttcaaccattaatggtgttgggttagttatcgaacttttctacgttggtgtctacttgatgtactgtggtcacaagaagaaccatcgaaggaacattttgggattcttagctcttgaagttattttggtggtggctatcattcttattacgctctttgcgcttaagggtgattttgttaagcaaacatttgttggtgtgatttgcgatgtcttcaacattgctatgtatggagctccttcattggccattattaaagtggtaaaaacaaagagtgttgaatacatgccattcttgttgtctttggtctgtttcgttaatgctggaatttggactacttactcgctcatcttcaagatcgattactacgtcctcgcaagtaatgggattggaacctttttggcactttctcagttgatagtgtacttcatgtactataagtcaactccaaaggagaagacggtgaagccatcagaagttgagatttctgctacggagagggtttag

SEQ ID NO: 13 - protein, 258 aa, Arabidopsis thaliana
MVFAHLNLLRKIVGIIGNFIALCLFLSPTPTFVRIVKKKSVEEYSPIPYLATLINCLVWVLYGLPTVHPDSTLVITINGTGILIEIVFLTIFFVYCGRQKQRLIISAVIAAETAFIAILAVLVLTLQHTTEKRTMSVGIVCCVFNVMMYASPLSVMKMVIKTKSVEFMPFWLSVAGFLNAGVWTIYALMPFDPFMAIPNGIGCLFGLAQLILYGAYYKSTKRIMAERENQPGYVGLSSAIARTGSEKTANTNQEPNNV

SEQ ID NO: 14 - protein, 261 aa, Arabidopsis thaliana
MVHEQLNLIRKIVGILGNFISLCLFLSPTPTFIHIVKKKSVEKYSPLPYLATLLNCLVRALYGLPMVHPDSTLLVTISGIGITIEIVFLTIFFVFCGRQQHRLVISAVLTVQVVFVATLAVLVLTLEHTTDQRTISVGIVSCVFNAMMYASPLSVMKMVIKTKSLEFMPFLLSVVGFLNAGVWTIYGFVPFDPFLAIPNGIGCVFGLVQLILYGTYYKSTKGIMEERKNRLGYVGEVGLSNAIAQTEPENIPYLNKRVSGV

SEQ ID NO: 15 - protein, 247 aa, Arabidopsis thaliana
MNIAHTIFGVFGNATALFLFLAPSITFKRIIKNKSTEQFSGIPYPMTLLNCLLSAWYGLPFVSKDNTLVSTINGTGAVIETVYVLIFLFYAPKKEKIKIFGIFSCVLAVFATVALVSLFALQGNGRKLFCGLAATVFSIIMYASPLSIMRLVVKTKSVEFMPFFLSLFVFLCGTSWFVYGLIGRDPFVAIPNGFGCALGTLQLILYFIYCGNKGEKSADAQKDEKSVEMKDDEKKQNVVNGKQDLQV

SEQ ID NO: 16 - protein, 240 aa, Arabidopsis thaliana
MTDPHTARTIVGIVGNVISFGLFCAPIPTMVKIWKMKSVSEFKPDPYVATVLNCMMWTFYGLPFVQPDSLLVITINGTGLFMELVYVTIFFVFATSPVRRKITIAMVIEVIFMAVVIFCTMYFLHTTKQRSMLIGILCIVFNVIMYAAPLTVMKLVIKTKSVKYMPFFLSLANFMNGVVWVIYACLKFDPYILIPNGLGSLSGIIQLIIYITYYKTTNWNDDDEDKEKRYSNAGIELGQA

SEQ ID NO: 17 - DNA, 723 bp, Arabidopsis thaliana
atgacggacccccacaccgcccggacgatcgtcggaatcgttggaaacgtgatttctttcggcttgttctgcgctccaataccaacgatggtgaagatatggaagatgaaatcggtctccgagtttaagccagatccatacgtagctacggttttaaactgcatgatgtggacattttacggacttcctttcgtccagcccgacagtctcctcgtcatcaccattaatggaactggtcttttcatggaactcgtttacgtcaccatcttctttgtcttcgctacctcccctgtccgcagaaagatcacaatagctatggttatcgaggtaatattcatggcggtggtgatcttctgcacaatgtattttttgcatacaacaaagcagagatcaatgcttattgggatcttgtgcattgttttcaacgtcatcatgtatgctgctcctctcaccgtcatgaaacttgtgataaagacaaagagcgtgaaatacatgccgttcttcctatcattagccaacttcatgaacggtgtcgtttgggtcatttatgcatgtcttaaatttgacccttatattttgattccaaatggtcttggatcgctatcaggaataatccagcttataatatacataacttactataaaacaactaactggaacgatgacgatgaagataaagaaaagcgctattcgaatgctggaatcgaacttggccaggcttga

SEQ ID NO: 18 - protein, 251 aa, Arabidopsis thaliana
MVNATVARNIAGICGNVISLFLFLSPIPTFITIYKKKKVEEYKADPYLATVLNCALWVFYGLPMVQPDSLLVITINGTGLAIELVYLAIFFFFSPTSRKVKVGLWLIGEMVFVGIVATCTLLLFHTHNQRSSFVGIFCVIFVSLMYIAPLTIMSKVIKTKSVKYMPFSLSLANFLNGVVWVIYALIKFDLFILIGNGLGTVSGAVQLILYACYYKTTPKDDEDEEDEENLSKVNSQLQLSGNSGQAKRVSA

SEQ ID NO: 19 - protein, 236 aa, Arabidopsis thaliana
MDVFAFNASLSMCKDVAGIAGNIFAFGLFVSPMPTFRRIMRNKSTEQFSGLPYIYALLNCLICLWYGTPFISHSNAMLMTVNSVGATFQLCYIILFIMHTDKKNKMKMLGLLFVVFAVVGVIVAGSLQIPDQLTRWYFVGFLSCGSLVSMFASPLFVINLVIRTKSVEFMPFYLSLSTFLMSASFLLYGLFNSDAFVYTPNGIGTILGIVQLALYCYYHRNSIEEETKEPLIVSYV

SEQ ID NO: 20 - protein, 263 aa, Arabidopsis thaliana
MGDKLRLSIGILGNGASLLLYTAPIVTFSRVFKKKSTEEFSCFPYVMTLFNCLIYTWYGLPIVSHLWENLPLVTINGVGILLESIFIFIYFYYASPKEKIKVGVTFVPVIVGFGLTTAISALVFDDHRHRKSFVGSVGLVASISMYGSPLVVMKKVIETRSVEYMPFYLSFFSFLASSLWLAYGLLSHDLFLASPNMVATPLGILQLILYFKYKNKKDLAPTTMVITKRNDHDDKNKATLEFVVDVDRNSDTNEKNSNNASSI

SEQ ID NO: 21 - protein, 265 aa, Petunia x hybrida
MAQLRADDLSFIFGLLGNIVSFMVFLAPVPTFYKIYKRKSSEGYQAIPYMVALFSAGLLLYYAYLRKNAYLIVSINGFGCAIELTYISLFLFYAPRKSKIFTGWLMLLELGALGMVMPITYLLAEGSHRVMIVGWICAAINVAVFAAPLSIMRQVIKTKSVEFMPFTLSLFLTLCATMWFFYGFFKKDFYIAFPNILGFLFGIVQMLLYFVYKDSKRIDDEKSDPVREATKSKEGVEIIINIEDDNSDNALQSMEKDFSRLRTSK

SEQ ID NO: 22 - DNA, 798 bp, Petunia x hybrida
atggcgcaattacgtgctgatgacttgtctttcatatttggccttcttggtaatattgtatcattcatggtcttcctagcacccgtgccaacattttacaaaatatataaaaggaaatcatcagaaggatatcaagcaataccatatatggtagcactgttcagcgccggactattgctatattatgcttatctcaggaagaatgcctatcttatcgtcagcattaatggctttggatgtgccattgaattaacatatatctctctgtttctcttttacgcgcccagaaagtctaagattttcacagggtggctgatgctcttagaattgggagccctaggaatggtgatgccaattacttatttattagcagaaggctcacatagagtgatgatagtgggatggatttgtgcagctatcaatgttgctgtctttgctgctcctttaagcatcatgaggcaagtaataaaaacaaagagtgtagagttcatgcccttcactttatctttgttcctcactctctgtgccactatgtggtttttctatgggtttttcaagaaggacttttacattgcgtttccaaatatactgggctttctattcggaatcgttcaaatgctattatattttgtttacaaggattcaaagagaatagatgatgaaaaatctgatcctgttcgagaagctacaaaatcaaaagaaggtgtagaaatcattatcaacattgaagatgataattctgataacgcattgcagtccatggagaaggatttttccagactgcggacatcaaaataa

SEQ ID NO: 23 - DNA, 114267 bp, Medicago truncatula
  misc_feature (37187)..(37286): n is a, c, g, or t
  misc_feature (37411)..(37411): n is a, c, g, or t
  misc_feature (38103)..(38105): n is a, c, g, or t
  misc_feature (38107)..(38107): n is a, c, g, or t
  misc_feature (38130)..(38131): n is a, c, g, or t
  misc_feature (38134)..(38139): n is a, c, g, or t
  misc_feature (111454)..(111553): n is a, c, g, or t
tccaaacaatgcaatctcaatcactttgaagaagggaatgttctcaaggcctcttagaactgaaatatataagcgggtattgaatattcttcgagatgggattctaattggatcaaaaagatttgagtttcttgccttctctgctagtcaactgcggtcaaattctgtttggttatttgcttctaatgataaagtgaaagcagcagatatcagagaatggatgggaagcttcaataacatccgtagtgtttccaaatgtgcagcaagaatgggtcagttgttcagttcttccaggcaaacttttgaaatggcccctcaagatgtggatttaattccagatattgaaatcacctctgatggtatagactactgtttctcagatggtattggaaaaatttcacagtcttttgcaaggcaacttgcagaaaagctaaaattagatgagaatcgtattccttcagcatttcaaattcggtacggtggatataaaggtgtcattgctgttgatcgccattcttttaagaagttatcattgcgtaaaagtatgcttaagtttgaatccaaaaacagaatgctttgcgtcactaaatggagtgagtcaatgccgtgctttctcaatcgagagattatatccctgctgtccaccttaggaattaaagatgaggcgcttttggcattgcaagaggatcaattgcagttgctaggaaagatgttgactgataaggaagcggccttggatgttttggaaagtttaaatggagctgattcaaatagcattctagtcaagatgctgcataggttttatgagccaaacagtgagccttacctatcaatgatgctcaaggctcattatacgtaccagttatctgatttgaaaagcagatgccgaatatttgtgcccaagggccgagtcttgattggctgcttggatgagactggtctattgaactatggccaagtatttgtccgcataactgtggcaaaaactaaggaaaagtttggagatgaaaacttaaggaacgtggatggtgatgatagcactcgtattatagtaggtaaggtggtagtgacaaaaaacccttgtcttcacccaggagatatcagagtccttgatgctgtctacagtgaagaattagaagaaaagggcttgagggattgccttgtatttccacaaaaaggacataggtatgtatataatggatttgatttccaactgtatttgattgtaataatttgttttattcaagatagagttatcacttcttctacattaatccttggtcaggtgtgctttcattaactacagtatgtcattcatcatgcaccaacaaaagaagggggcatgtctttggggatgaaagttaaaagggtcattagctaggcattgcattgcatgtcaattagaacattcagaagcctctacttactcagttatcattggcattgcaaattgctgacctcatgcgcataaccagatccttagattcattgtttggtggacaagttgacagtgatatgatatttttcattgttcatataccttgtttagatataaaaccactcactcataagatattaggcttccacctaacaacaaattaaacttttatgagtgttggtacttgctattgcatgagggatgtgttagattaaaaaaaaaaaacattcacaagctttcaactaacaatttctgttaattttaaaatgtttgtcttgtattgatgtttattgctttttaatacttgctgggtctacaggcctcatccaaatgagtgctctggaggtgatcttgacggggatttatttttcataagctgggacaaagatctaatcccagctcaaactgaaaatccaatggactacacaggaagaaggcctcgtataatggaccataaggtgactctggaggtaacttttcaaccaagttgcatactttgtacttgtttcctatgtagcaccaacacatgtcaatgtcactcatacaacaccgacacatgtagatacatttttcatttgacatctttttaaatcaccactgatgtctgtgtctattttagtgtttctttaaacaaaattgataaatttgaaactgctccttatatgtttgttactgttgcataggaaatacaccaattttttgttgattacatgatcaatgatactttgggtgctatctccaccgcacatttggttcatgctgaccgtgaacacgataaggccaagagtagaaaatgtctggagttggctgagctgcattccatggcagttgattttgcaaagactggagctcctgcagaaatgccaagatctttgaaaccaagagagtttccagattttatggagaggttcgaaaagcctatgtatatatccaaaggtgtattaggaaaactctaccgcgccacaattgattcaaacttgcaagtaaggtttgacatggtcatgtctgagaagtttgccaaagaagcatatgatcaccagcttgaagttgatggttttgaggtctttcttgagactgccttaagtcacagagatatgtatgcacagaagatgatctctttgatgagcttctatggtgcaacgactgaggatgaaatgctaactggtaacttgcaaaaccgtgcatcttatttgcagagggataacaggagatatggagatatgaaggatcgaattctaatctcagtaaaggatcttcagctggaagctaaagaatggtttgaaagtgattgtcagccgcatgaatatcaacttatggcatctgcatggtaccatgtgacctatcaccccaaatattacatcgaaagctccacttttttaagctttccatggattgtcggtgacattttattgcacatcaagtctgcaaatgctccctctgtcccataatagcttttacatttacaaaaaaaattgtcctaaaaagattgtcgcttagttatgaagacataccattttgtagtatgagtatgacatgttcatagcacgggtagcgcttggatgacatagattttggtgacattgttcttatctctctcttaatcaatctttatctctcatctaaataatttattttaatcattcatctatcattctttctcatctaaaatacactaatgtcaccaatgttaccaaaaagctatgtcactcaagtgaaatccgtttatgtacacgttgattgaaggtgttcgactctgctagatttatttacttctgtcataataataataataataataataataataataataataataataatgaaatcaactgacattacaaaaatgaaattgacacatacacatatagttacatcaatcactttcatttggctcgtacttgtgcttcgttaacaaaatttgaacttgtttttcatttgtttgatacctctatgtagaaaatacacaaattttttgttgattacatgatcaaggatactttgggtgctatctccaccgcacatctggttcatgctgattgtgaatcaaataaggccaagagtagaaaatgtctggagttggctgagcttcattcaatggcagttgattttgcaaagaccggagctcttgctgaaatgcctagagttttgaaaccaaaagagtttccagatttcatggagagatttgaaaagcctatgtatgtatccaaaggggtactaggaaaactctatcgcgccttagttgagtcaacgatgcaattgacgtctaactttgtctcgtcagggaactttttgtcgaagaagcatatgatcatcaacttgaagctaatggttttaaggcctttcttgagactgcctcaactcacaaagaaatgtatgcggagacgatatggagatatgaaggatcaaattatgatctctaaaggatcttcaacttgaagttaaagaatggtttgaaagtgattgtcagccacatgaacatcaacttatggcatctgcatggtatcatgtgattcatcaccccaaatattaccacaaaagctccaattttgtaagctttccatggattgttggtgatattttattgtatgtcaagcatgcaaatacctccactgtcctacggtgactgtcacatttgcaaaaataaatgaaaaagatattactttaaaatgattgtcacttttagctacaatgtaatttttattttatttttcaattgtaccttttaattagtactatatgtgtcacttctaagttattagttattacatttgcactcataataatgagaatacactggtggttaatgaagttgatttggtaaagtgtttttataaaaaaaattatatatactttctctttaatatgtgtggaatgtgatagtttgtttcaatcccaaaaaaaatgtactccctccgttcctttttatgtgtcatttttggagaaaaaatttgttcctatttaactgtcactttcaaagttcaatgcaacattaaatgttgttttaccaatattatccttagttatttattgtggagagataaatatatgaaatgagatattaaataaataaggtcattatagtaaaagtatagcttattgcatcaaaaatagtttcaattgttgattgtcttggtttgtgtaaaatgtcaaaatgtgacaattaaaaaggaacggaggtagtaatagttactgtgggacggatgtacagttgaatggttttctctagtgctctatgcaatagagaatataatatatgaaaacaagccattttttagtggatgataagtttatatatgtacatgttgattgaatgtgacatttcgtttttatgcgattctgctagatttacttctgtcaaattaataacaatatcttcattattatcttatctcaatccgtttctaactaataactacattaaaattgacatctattttgagatgattttttttgtaaagtgaccctcgttgtacttaaattaaggcaggacataggctatagcttaaacaagttgcaattactccacatagagataaaaaacaaacaaaattattaataaacgtattgataaagaatgttcttttttgtcaatatggaaaaagaaatttactacggtcactgtgggcttgtaaaaagcatctgcgattgaccaattgaagaatgtcacgtcattttaacgtttagtaaatgtttcctaaacattatatcgtaataatacaccctcctttgtccttacattaaggggaaaattacgtattctcttatttctgtctaagggcccgcaactccgcagaaattggtcttgtaaagaccattaggtaggggagactcaagtggacaggagaaaagaaactgggacataatgcctaatatgaattgcattagcgatcattttaccataaataactcaagatctaagttagataaaattcgcgataagagtttatatataagaaacactcatcaacttacaagtcagttttgttagaccaaaccacaatttttaacatgacatcagagtttgtcggattcaaggatcacctatcaaacccaaaaaatattgggcgtgagtaaggatgcgttaggctcgaaatttgagaaagtaaaattgactatcaaaacatcttgaaaaagaggaaaatcatagtgttagaatctatattatcatttgctgatgtgccaaaaaagagaaaattttcttaccaagaggataaaaacactttatcctacctttttaccctacccctacccagcaattccctcagtcgtacacaacacgatcatgacacacacaatgagatgcttccaagaagcctctcaacttggcctcaactcaaatggtactcgatcctcttggtttatatccctctacccaacaattatcaatatcatccaaaagatgaaaatgagatgaaggtgaagaagatattcccgacaaaaaacgagttgaaagtatcctaattggacagccaattcatttcgtgaaagactcattttattgatatttcattatcacaattctaacaacaacaaaaaaatcacaattgacaattcgcaaagcaacactccaccgccgtattggcccatctatgataatcattagccattatgaaattaaaaatatcaagctaaagctataactataagcatcctcactccaccaaccattaattaaaaaaattactatgataacaattaattactactgtatgatccaatagcggcaaaacaaaaagaaaaagaaaaaagtaataatcattataataaccatttccactttgttaccaacatatttacaatataaaaagaaaaagaaaaaagtaatttctcatagtaaattatgaaagtacaaaataaaccgaaagtgacgcaatggtttatgatggtatccacggtgtaatgttttttacactttctccagctcataatgtgcccactccagcgcacattagctcatgccgcgcactcaaacgaacccgccaatttcaccctccggttccggtgcaacagacttaatattaacagcggcgtaacgcgtagagaaattccgaaaaccgtcgtcatggctatcctcgttctgtccctcatcaaagttcaacgcgtaactcaaaggatcgtattgacactttgtcatacgcttcgatcgatggttgttgaatttccgaatgaaattcttccatcttggaccggcaacgatctctgaccaattgcggagtttctttaaggctttgaggcctcgagaccaccatctatccgcggtggttggaggatgggattgagaaaaggaggcggagcggacgcgttcccaccaaacggaacggcggcgggaggcgaagcaggtggggaaacataaggcgcttgatctcttttgttggagatgagcggtgggtgattcgagctctagctcaacggacatgtcagaaactaagattgatgattttgtttgaaaatgattatgtgatgatgaagttttatagttttgtagtatacagatggagatggatgaagaagagagtgtgaggaaggtgtttttccgttataaagaaataaataggtaacacattcgggttcgggtggccacacacggagtatttaatatcctactgtaatttagtgtacactatactgcaaccactcactcaagtttatcaatatatttattaaaaaacagtgttattattttttaaatagataaatcaaaataaacaattaaaaattcacggtgcatgagttgagattcaaaatctaatcaaaactttcgacttgctggttatattagcatgcagtattttactgacttttttttttttttttttaataaagtgtgtactattttacaatgtgaacaaatttaatgtttcaccttaaaagttaaaattaaagtcaaatactttaatgatacaagtataattaatagtagtataagattttttttttatattattgccaataaaatatcacttgtgttgtgtctataagtaatttaatacttgtaatttttctatataaaaagtagtttgtgcaataataatatgttaatgaattaatagagaggaaacgagcggccacagggggaaaaacagcgaacgttatccaaagaaaaaccacggagtgacacacgtattgggcacgggtatctcgtttcgttggtaatccagcacagcacccttggcagtgactgactgcgtctactagtactagtggtgagtcgtcgacatagtaaagtccaccaatgcagctgagcctcttatccataattctgtcacctcaaacaaaagcatctttcctttcttaccgcctcgtgttatttgtcccaagaatattgttatttacacatgcatgttgtttggctaataaattatccaaatacttatcggcagttaattgccgaattttgaagaaatcggctgcagttaactacctaggaaacttaaaatctagaattcatgaatatagtgattctttcctcggtagttaactgcagtcggttttaaacttccacgacagttaactaccgagaaatattttcgtattttacatgtatttctcagccaaacaacatgtgtatacaacaattttcttgtcccatctatataattaatactgcttcattttcaattttaaatgattaaatttctatttttataaaatagtaaatagaatttttattttttttgagggaagtaaatagaaaaattattattaagcataatgtgaacatagattaaactaaaccctatattttacaaattaatagatacatcattcaaattagggtaatgctaaccgggatattgattaagaaaaaaaaaacaattaaatacttttttaaaatttttgagaagttgaccgcacaagttctaatttcaaattccttgatcattggccgagagcatcggttaacatatctcataaaactaaataccttttgacttttgtttctattaaagatcggggaagtatcttttatttaattcataaaattaaatgaaaagtattaccaatgttcataatttaagaacaatctgtttattcacttgctacaaaagggtacacatcaacctaaaatatatgtgcaaaactgttgtttttaaagaggcagaataaaatatattatatattaaaagcttcttcaaaattattgttcaacgatttttctttaaactattaagccattgcacttgacgtgaagcacaaattttgatagctccataacaaaggttgcagccagcatcatttggctcaacgaagcatcattatgtttggattgaacccaaagatagattctctcaaagtgatcaggggataactatcactgctaatatcacatagttaaagatattatgagatgatctctgcaattttcatccaaagagcatctcctactacctgttgttgcatagtctctaaaacattttagcagtacaatgacattgattgttttcctgtttcctttaagggttaaatgagaattatgcagctgtcaactctccaatgttgatgattattatgaaaggactccaacgttatacaataagtaataccaattgatccattaccatacgtcaccaatgtgtttttaatggtaattcaacaagaacatcgattacaactttggcatcttgtctagtcctacaattcctaatgtcaaaacaaagactcagcacatgaatgccagaggcaaggccaatcctaagttcttttccacaaaatctgctgtcttgaagcagcaaatctgctatgagacaaaaatggatcatttgtcttatcgctatccgctataccgaactcaaaggctatacacagtctcagtcatactgacatgactgttgtaggttggaaatggatggacaaattaaggcctcagaaaaaacaaaaagaaaatctggatccttattgaacttcccataaggcaaaaaaacacatggaatacaaatgattaaattttttaaatcactagtaaagatcccgtgcaattatggggaagttgcagaaaacagaggtgcaaaactcagccacatgtcaattgcagaagacttctcatagataaaaaataaatagatttcctccaaacttcaaagacatgcgtgacatcaagttgttggtctttaattagtgtaagatgagcactatatagactaaattagatgaaagaaaagttgagggataaagagatgcccgttctgaacatgagggaacaaactgatgtctgagaattttagaagaccagctcaatgtatttagtcttaaagaactagcaccacgagcacttggagcaaatcaccaattcgccccctaaaactgtagggatcgagtacttcccccctgaaatttgttgatagagaaaaaagatcctgattttgaatgacatcaggcaacttggtccttctattaatttttaagtttattttgaaaaagagtccttctggtaacttgtaagaactagtttgaaagtaagttatttaattcagagactaacttgttggtaagtgataaaattcaacaactaatttgacaataatttaggtacaagttaacagatagaccaagttgctcgatggaactcaaagataaggttttttttcctgttatataattcagagactaatttgatggtaaatgatagaattcagcaactaatttgacaataaactagattcaagttaacagaaagaccaagttgctcgacgtaactcaagatcaaggtctttttttcctgttaacaagttacaggggtaaatgctcgaaccctacaatttcatgggatgaattgttgattcactcgaagaattgatagtagctacaaaattagtgtcctgcacatctctagaggaccgacctaataatatcgccctctttaatcaaataataacaaatctcacaataacaagaatgaaaaacaagtgtcagtagccaattgacctcatgatgttaatacttcatagcattatacatatacaaatacaaacaacaatgataatgtaaaaacaagcagctatatatcttaagtcaataaaacaggatcagcgacaataacatcatacatagaatttaacaacttcacatcataagtacttatatataagctattactataccaaaagataaaataaagacaaattgttttcatataagctatcatgacgagcttacaaacatgtcataagtcattttaataaactccttcaaacagtctcacaagtactaattagattaaatacatcaatccaaacataccctaagctaattagataaactaaaacttaagtactacaaacaactaaaacataagctattaaaaagtatcttcaaaatgaaacacaaacatgggtactgaaaggtgacctacatttcacatagccgcgtaaacaccaagatcacgaccatgaacagtcaagaaaacattaccagcagcctccgaactaccagtatcaagagaaatagcaccaaaaattgatcgaaaagcaccacaaaccacagcagtggaagaagaattggtcttgggcgagacacgaacaaccttgtgcaaacccaaacgttttgcatcaacagcacaagaagagtcgacgttggagattaaggatagtcgacggttcaactctttagcggaaatatcaacgtctttcgaaagcaaattgaaagaaacagatgtttcaatgcttgtagcacccaaaatgctgaaagctttgttgttttcttcagagaaagaagcgtgagtcattgcacgacgaagaagacttatgctcttgaaagtgtacctgatcagtatgtaacaacacgttaaaatgaacaaattaaaaaaaaaaaaaaaaactgaataaaaggacagaagcaaaccctaattgtttctggagggtttcgagtgcggatgaaaatggtgagaatgagtgtccctgcaggcacaaaagaaaaggatagaataatgaaaacagtttctattaatggattgtttggattttggagtaaaatgtgaaagaaaggggaaaagggacctgaacgatggtagcatgggggaggatcgcaatgaggaagatggtgaagatgatgaaggtacgactggattgcattttgaatggagcgcaacggaactctcgttttgctcttcactctcgcagtcacactcaagttgaaagcccttttacttctctgaattcgttaccaccaaataacaaagtgagttttgatgaaagtgtttgtttggtaccagagaaatggaaggaggagaagttttatattctttttttgagagaaaggagaagttttatactcttctttaatctttataataatataatataattcttcttcatagaaagggaagatgatgatttctagaaattatacttcaataacatttttcaattaatgtaaccttaaatattacaataataaaaaatttattttacatttttttaatatttcattttctcgttgaacctaatataaaatattgaggtatgtcatttaaacaaccacttttgtaacaacttataagaagacaaacaaaaatatataaaaaatattgtcagaatgtcaaaataaataggaacaccttgaccaaaataaaataaaatgaataggaacacaataaaggtatgaaagagacttattctaaaaattattaaaaaatagttgtgtaaatatcttttctctaaagtattataaatttcttacctccaaacaaactcattttttataaaaaagttcttatttcattatatcaacaatatcaactgctaatataagaatataaaaagcaatttcatttaagggtaaataatatttttaaatattttacttcctttgtcaaaaaaacattttacttcttaatattttatgatcttgtcctaatgacacatattaagggagtttggcttcactatgttaacattgctatatttattgtgcatttttaaaagagatagacaaaagagataaaatagtgttttagtaatctcattaaattatcgtttatatctatcttttttgtaaatggacaataaattaaataaagtaaattgagcgaaactaatctcactttaaggaattgatgttgaacaaagattgaatatacaccacattggggatggtaaagtgggtctcccgccctatttagacctgtctaaaacgggaagacgcaaaccgagtcaattaaagtggtcgagtctaaaattccaccccaccctgcttagtggcagaatgacgagttgaagggccggtccgtcaagcaatttgttttaatgcattatttttttaaaagtttttgttgctataacaaattatgttgatgttatttgaaaaaaaaaatgacaacaaaggcaaaaccgaaaatcgctaatattactggagataaacatacattaacccttatttttaacattccttcccattgctcctaaaaaccgacatcgtttttccctcttctatgtcacatgcgtttatgttaacacaataattaccatgtattaaactttagttaacttatggtatgatttctaactgaaagactaaaacgtctatatttttaaaaagataaaggaccaaaacatgtcaaaaataagataaaaaatcaaaacacgtcttttttaaaagataaaggaccaaaaatatatctaagtctttctcctaacacgtttcattcccaaactttaaacaaaaaatgtttttttttactagaatattcacattttatttttatacacttattcaacatctcattgtggtattatatgaaaaggaataaaaataaaataacctatcattgctgttttttaaaataaatacaaaattgattatttgtgttttatcttttacatatttattgatgttccattatgcatctgtaatttgatatttaataaaatgttacaagtatcaagaaaaaaaaaactataatcaatttattttaaggagaaatcctaaccctcccaatcccatcatcattcccatctacccatcatcatttccttgtccttcaatccttacacgttgtcatcaatttttccttaaaataaaaataaatcattttggccccttgttggctgaaaagaacaactgcgagcacaaacgggagccacacaataagcaaaacactagcttgtattgagttaaagacaaaagtgaccgacattcactgttctactaggtgtgttacaattttaatgaccaaatcagtagtttatattatattaatgtgacgttaaccacggtacattacactaatgaaccgtgtatttgtaaatattaatgtgataactttttttttgaaggaattaatgtggtaacttattgcacaaattaaaacagaagttgtaatctgtctcacttctttttctttgagtaatgtataaacaaagaaaaatatttgataacatgcaattggcaccttgaaagagaaagaatttagaaaatgtagttgatgttaaataccgacaatgtgatatacacaagaatagggtgttaaaagagttagttgcggctgcaattcgataattaatgtatttagtatgtaataaaaaacaaaacaaaacaaaacaaatacatttgttatttataactaagccaggagggagtaatagtttaattttataaggaaggaaatatttaactagtatagttatagtttattattagttagttgaataggctgttagcttgatctgccaccttgaacttggtaatagttagaacacattacccgcactaactttacctttttaagactgccacatacagcacagttagttatctatcttcaaaggcagttgagactgagaggatcttgactctgttgagtgaaggaacttatattgtttgttgaagctgaaagttgaaagtgattattttatttatgccatgccaggccctggtcctcacatgatgtatgccatgggctcaggcttgtgtctaaccaccgtcagtaacggcaggtttagtccacaccatacactcatctacaccatcaactctttctttggacctgatattggttctttctctcagtggcttgtctctctttttggtggtcatactgtagcctctacttttgctgattacattcaccatcctttctactacatcattatcttgggatatcctctatgtcttctttactctaggatttcctcttttcttcttcataaacactttctagattcttctttctccaaggtcattaattgatctagttgtttcatttcatcatttattattattattattatgaattaattaattactttgataattgatattgcaggtgccacttactaagatgcaatgtttgttcttgatatctgctggctctttgactcacttctttcttgatcatctgtttgaggtaatattcattgatacaataacatttcgatgctgtttatgtaaccgtttgtgtttgtttctacaaactactagctagctgattgatttattatcctaattagtgaaacctgcttaaaatagtaacatgtatgtctaaagcggtttcaagtatttatggagattgcctcatctggtcttggactttctaaaattaaaatcaattttgatactatacatgttttgtttatttatgtccaattttgacaagtaggggatgtttgattgttcccacatttattattttcttgaattccatgtcatgatgatattaaccttgaaatttttacatttgtttcgttaacatttgttaaccttcttaaatctgtacataatttgttatctagtgtttttaactactctatcgagaggtaaacaataacagaaactgttagatgcatagctgaatcttaaccaactcttgtacaccaatactattctactaggtttcaactttggtttgtctcttattcttgtctcataaggttgatatgtttttcggttcatttccttatttttcctttagtaatctaaattttgaagttctgtgtccgtagactttacaagtagagtgctattggctattattttaatagaaacaaagaaagaaactacaaaatgaagctaaattcctactagttgcaagccaatctaacagtgtcgaagacaaatgttcttgccgttttgttataactctttctaaaaattgtcacttaaactcttaattgattcaagcttataaccctcaaaatcttgtaggagaatgggaaaacgaccatgtacacttggattttgagtactggttggtggcaaggaagagcaccagttaacccggatgctgttgttgtagtcggcttcttgtgtgtttgcttaattggtggattcttttacctcaacaggtgttttgttagactgctttccacccctttaacacttctctcccaccctatattatttcggattttagcttctgaatggaaaaaacacatcaagaaaccccccttttttttttctttctgattttaagatccgaatgtagggcatgcgaatagttgggggcctaaaagaaattctcgttttgttattgcaactttccatgttcaatatcaagttatactatagaggttttaacatattcttctttctttttcattgccttgcagagcgagttcctcagactcgataaagaaaaaatcatatcagtcaatgctacttatggtatccatagcttctttatactgcttgtggtgtgcaattcagatatacgtgatcagtctgcgccgtccagcaattggagaagaggctgatcttggcgttatcatttttttcgctttctatttctttctaccttattgtttgtgtataacgtccatgcacccaaaagatcttgattctaatcaaattccacgttaacggtgtttactttgacatatatgtactgcttttgccagtccaatctggttgctaggttagctagaatctcgccgccggtcacctgtataactcaccaggcatatgtgatgttaaacacgaatttaactaaaattggagctcaactcttccaaatcatacatgtataaatgtaccatgctctgtaatttgaggcaaagttattgaatgtagaagtttgacatttgatttctatcatagtcttgtaagttgtttttataaagcatattgtatttgtagctgctaatcacattaatttcgcccgttgaatatgaaattctggttttaaatcaaacctcaagtccttataacattaacaagcttgtataatggatgaattctggctgttccaagttacgactccaccaatcaccattagttagattcacatctttttacatgagtatttggttactcaccattagttagtttctacatgaaaataatcactatatttttatattcaattaattgctcatttgatttttcttcttttgcatttaaaaattcaactttgcgttggtcctaaaatgaacaatcgattgaagaataaatttagagatttattttcttattgtaaggaccatttatatccctttgctcttgtgataaaaattttattgtcggagatctaattgtttttttgaaacaatattatcacaaaaaactgacttatgagtttaaataaggactaagttgtcctcgtatatccttctcaatgtgatatgtgacaattttgtgatgttatagaaggaaagatatgtaaagaaaacgaggtattttattagcgaagaaaaatacagtaaatgatatctatattatttatggtgaaatatatccatttccacttgcatatcatatagtttgtgtgaaaattttagctcatactccaaacttttagtctagtaccacctactatccccttgcaaaccatatgagctacctaaatcacttttcctcttaataaatacataaaaattactactattttttatcactttaaatttaagattccccaaattaacaggcttgaatttgagttttcccaaaagcgaatttccctttgtgtttgtcttcttcccgcttttctccaaacgtacctgcctgccacaaacgtcatcccaactctctctactcaataatgctatcatttcctcttaatagaaagacaaactttttcaactctctttattaatacaagcaagaattcaataataacccttcaaattaattaaccccacaagattttcaatacaataattaatgacatagctctttcaatggtttcttgtaagttagtagtatttcacatcatattagcgataagattaatatcaacaacaacaacggttaccaaacaaatggtgcatatgaaaaatcatttttcacattgataagttttgtttcttttttatcactaaatcattacaagaacaagaaacaccgacaggcaatcacattcacgtgctctcatcatggcagctcgcacactttctcgtttgctctctcgctccctatcttcttcttcttcttcttctggagcttctgcttctctgcttcgctcaccgcttggtattcaattccttatcctgtaactgtgtgtggatatactttttttttttgtaatgcatggaataagatttctgctttatgttttgtttcacctcaggaagaaaatctgaagggttgataaacacaaacagatttagcactgctgcagctgttcaggaattgattactccacaagtttcaataaattatacacagcatcttataaatggaaagtttgtggatgctgcatcaggtaatgtttaaagatcgttgcttgttactccctccgtctcaaaataatagtcgttttaaggtttgtctcgaaaaatcatttattgagtggaagtgagaacaagttaggctcttagattaaacacggagtttcttttgattccagggaaaacatttccaacacttgatccacgcacaggggaagtgattgctcatgttgctgaaggtgatgctgaagatattaaccgtgcagtttcagcagctcgtgaggcctttgataatggaccttggcctaaaatgagtgcttatgtaagcatttcctgcagagtgtcctttcttgcatgaacttctattagttttcaatttacgttgatgattacttattaataactccttcaggaaagatgtcgtatattgttgcgatttgctgatttggttgagaagcacaatgatgagattgcagctctggaggcatggaacaatggaaagctttatgaacaggctgccaaagctgaagtacctatgtttgtgcgtttatttcgctactatgctggtaggatcggatcagtaacaacatgttccttatgtcaatgtcttttttaattgttagtaaaaaaaataatcatgctaatatccccagtctaacaattattgtttttactaggttgggcagataaaattcatgggctgacagtcccggctgatggagattatcatgtccagacattgcatgaaccaattggtgtagcaggacaaattataccttggaattttcctctacttatgtttgcttggaaagttggaccagctctagcatgtggtaataccattgtcctcaagactgctgagcaaacaccgctaacggctctacttgtggcaaaactacttcatgaggtcagctcataactcgtaagccatgctttgatgtcaaaagaaatacaaaatgctctgatgtgatgccaattgtgaaacaattacccttgcctttagtttttgacctcatacgttaacctcaattttggctagcatgctgattatcttatttagatttctatgactatgtaagttgtatttttatttacaaatgttaagttgtaattttcacacttttgggcaggccggtctacccccaggtgttctgaatatagtttctggctatggtccaactgctggtgcatctcttgcaagtcatatggacgtggacaaggtattttgagaatcaagcatcttaacttctactatatattaatatatagttctataaagcatcaccgatgaacttagcttgattataaagatgcattattccaatccattatgtattactgctaaatatgtttaggataccatcaaaatgcattatgattgagagcatgattcgtctaaatttcatgatgatattgatttgatagtagttcttgtttataccttactgtataagagaggttataaaaattggtaagtaatgaaagaaatcaagacatgttatcttgaagttagcattcactggataatattgattcattatttggcatacaaattcaatttttttttactttcttaatttttgcagttagcgttcactggatcaacagacactggaaaaactgtacttgagctggctgcaagaagcaatcttaagccagtgacattagaacttggagggaaatcgccattcattgtttgtgaggatgctgatattgacaaagctgttgaaattgctcactttgctcttttctttaatcaggtttgtgcaatccttttccactactttctaaaacaagacggaaatgtggagtagaagcttatgccttaagctggatgcttttcagggacaatgttgctgtgctggatcccgtaccttcgtacatgagcgtatctatgacgagttcttggagaaatcaaaggaacgagctttgagacgtgttgttggtgatccatttaagaagggtgtagagcaaggtcctcaggtatttttatattaagttaactttattactattgtaacgttactttataggtctatattccttgtctcatttttctttttcttttctagtgtttattcgactaaccttttcatgggaaaaagctaatgtttgacagaacaacacattcttgatcatactatgatttaacaacataacactgttttgtggtccttgcaaataatcgcagattgattcgaaacaatttgagaaagtacttaggtatataaagtctggaattgatagcaatgctacacttgaatgtggaggtgggagattgggttccaaaggcttctttgtccagccaactgtattttcaaatgttcaggtattgattatttgccacaagtgactgtttacagaaatgcaccgtaagaccgtgtattgtggaccattttctaacacatgttaatggctattacataggatgatatgttgatagctaaagatgaaatatttggcccagttcagaccatcttgaagttcaagtgagtgaaattggaatcccacttgctttgttttttttttgttgaaattcagtaagattaccattatgttccaacttcaaagctattctgcatgggatccttctaaatgaatcaatttcatcgttatttgcaatcacactttaaaataatcttatacacataatcaatcatatttcagtatggcatcatgcatagtatggctttctaaaatatctgcatatacttttaaatgattaagtatgatcagacgcctgtctaaaatgtttgtatacagttgttccttagttattaaattctttataaaattagaattagaattcaagacagtgccttggaatatctgtagtgtggcgcgcaatttggaatttttctaatattttttattcttctaatattatatagggacattaatgaagtgatacgacgggcaaatgcgacacgttatggtttagcagcaggtgttttcacaaacaacgtgagcacagccaacactttgatgcgggcactgagagctggaacagtgtggattaattgctttgatgtgtttgatgctgcaattccttttggtggttacaagatgagtgggattggcagggagaaaggaatatacagtcttcacaactatctgcaggtaaaagctgtggtgtccccactaaacaatcctgcgtggttgtaactattgtacttgtttagtttgttggttgtgcaaaccaattatcgaaaagaacttgtatgtgattaagtgatttcgtaagacactataagcttatacagtgaccttgatttacaatgatctcgagtttgtatcaacaatttagaagataatgatttataatgatctcgagtttgtatcaacaatttagaagataatgatttacaatgatctcgagtttgtatcaacaattttagagcaacaaagttgttatcattattcagatcaattttttaaagttattattatttaaaagaacaaagaccaattttagagccactgaccttctgattggagaatgaaacagtcaaaatcatcaccgttctcaatggaaaattaaataaaaagaatagtttacaagcttacacagtaaattgcagtaaataaaaacaatcaacagagattttcaatcaataaagcatgagtgaaaaaatggtatccttgacaacaataaaactaagattcagtatataattaggatagaagtgactttagcttattcttccatgttatcctcctcatcttcatcctcaaacagatcaagggattcaaaaccagccatcaactcctccaattcagggtcctttaagaatagatcacgttccaagttgtaatcaactccaaccttatcatcaacctccataggaagtgatttccaagaacgaggcttcccacatctcttctctttataactcttctttattaaaatcacttcaggaatatgtcctttgtaattttcatattcagtgtcattactgttagccctatacaagtcataaccaagagcatggtcaccaggctttaaaagatgccccaaatgagttctaatagaaaagattgtgaaaaatccgaaactcgggcaacttgagcatcagctaaaacatattttgtgccacccatagtaatctcagatggaccaattttcgatgaaacaacctccagatccaacactatatattccaccaactctttgctagtaagtaaggatttgaaggatgccctccaatactgatcagcatctaagaaactgtacttcaaggtaagtggatcaagcaaagcaatgctgttagtaaccttggtgcaaatcacaataggaccaatattgcccaaagctatgtaagctttaggaggcaagcaaattaaatcctcgcgacaaatggggctgatttcaactgaaaacgtgtatttatagttgtagtcattactctttgaatcatgagaaacaagctgcttatcattacgactccttataggtgctacttttccaataaattccaaaaagctgttaccgtgacttcgtttagagaaatagaagtcaataccatgatccatttgtttgattctgacagctctagcagcagcaccatgcttcagaattagctgctccaaataaaagaaagtacgcctgtgcgagacatgttgcctgagttgcacaactgcaactcactgatcagggttagcctgcactctggaacatgattcacacatgtgatcctgttgaacatactcaacaaggtaagactgttggagaattgctccattataaacctccttctgaacactgaccttgacttttaccctcttggaatggggctccgtccaaataaattccgcatttaccaacttcactttattgacattcatattcttttgcaatcttttcaagcaaaatgccaacagctcctttgtttctaattgtagtttgacccaagttctcggtggctgcaagtagctttggcactcggggcaatgcacaatcacatggagcttcagtaagccttctgtaatatcaacttctgagcacaaacacttcaacacatattcgttgtgtttggttgcattgaaatcccacatttgcaacacaaaacgttgccaatcgtttgataaaccgtgaacattccagcttcttgtgccatgcctgatagacctgacatggtaagggagacaaaatagaattccattgagagaaagtatagagaaaaaagcttcaaattaaattaaaaaaaacattaagtatagtaaaaacatcgctaaagttgacctgcagaaacagaccacttcatttaaattcataattattgtctcaatagcatcacagcagtgaaatccatcttatagcatgaagtatgaacagttaatataagtttaaaaatagactaaggctatcagttttagttttttgcagttcaactcggtttggataactcacagaacaacagttctgatctgattttttgcggtctgaataggttcagttgattcagttagaattggatatccatgccattactcacaatttcacaacagtttcagtgaccaagtgatttgcaattttgcatcctacgagcaaaaccattgtgtccaacaagcacaaccatactcaattatttacatcactgtcaatgactaaaaaaaattccaaaaaacatgcctaaccattactgaatgactcaattaaaaggtgtattagtgaatgttacaagttacaaccaatccaaaacaggttaacacacaaaacactaactctaccaataccaaccttgcagtactcctaaatacattaaggcagcagcatatcattactcctttacataaaaatctttaaataagccaccaccaaaacacacaaacttgctatatataagctaaagagaacagacacggacacgacacaaacactcacagtcgacaccaataacattttgagacaatgacataattcggtcggtgcaggacaccaacactgacaccggaatacccctttggtcatcatttcggtgttaagacttaatagtgtataatctccaaatcaaattccacataagaatctccaaagtgcaaacatcaaatatatttcacgtaacattaaaaacctgacatctccacaacaagacttgaaaattttaatacaacatagaaagaagtaaaattataaaatagaacagaatacactagaaggtcgttacagggatcacaactcaaaaaggaaaaaaacaacataaataagcagaatatttacaaagagacgatcatagaaacaaaaaaccaaaggagaacaatgtgggatatggttggagaagactcaccttggcagcgtaagcttatgatcgcggtggtggaaaaaacggaagtagggttttctgaaaatttctatttatttttttaaatataattttattggtaaatatgtctaaataaatgggaatggactgggttgggcgtattttgaaactgtttttccttttttttttttttttttgtcggactagatttatgtattttttcttgaaaaattgtacgacgatatctggtttttattatttgctccccaaagaaagaagagtgtcatgtccataatgggtgagagacaatcctatcggaatttttcactctgaaccctttaaagagcccatgagccaaatccacatgcataaaaccccagttagaaacaatgttacatgtgctaaatgatcacattgacgcaaccttctatgaatatcaattttgttcccttggagaaccattaactaagattaaaagaataacagaaaagacactaagatctctacttattcactagagacaaacctcctcagcatacaaatattaaactataagctaaattataacattataagcttaacttataaactcaaatacaattaatatatttatgaaaatgcaagtttgttcattttattagtcaaataaattcaataactagattttaataagacaaaactcaactaactaaaatatcgttaatgttaggttagacttaccaaaaaaaaaaagttaatgttaggttagacacattcatttaggttcgaacatgagactttgcaattttatttgtgaattttggtgatgtttatcactctatctatttcacctataaacaaaagaaaatcttttcatggacgattagtttgtaagggcataagagttctattcttttttaaaggagtagctagatagagaaaagataatatgatcccacgtcttatttgtttcttcaaaaatatattcatattttcgtggcatcattgcaaacaagatgcgtggaagaattaagttaggttgacaaattctctccaaaaaaaagttccttaaaaaaatcctctaaaaaaacaagttagggttgtcaattgaatatattaacaatcaacgcgtagaggatataaaatgacctaaccaaaaacgattaaatatctaatcaaattactgcatgcatggggacatcacaattgttgtgcttcaccccctcaaaaaaaaattggtgtgtatcacacgtattacaacataaaatctattatcctaacacaaaaacataaagtccattaagaaattaagaaaattaacataaaatctatctaataacatttctctaccttggtgtatattaggtgacttcaatgatattctggatgtcaaagaaaaaagaggtggttctgtacggactcgttggttaatcaatgggttccgacatgctcgttggttgatgtttttatggaaggttatcccttcatatggtttaaaagtttaggtactccaagggcagttgaggaacgattggattgtgcacttgctaacgcatcctggtttcagctatttcctaatgcgaaggtggaaaatttagtagccccggcttctaatcattatccgactcttctcactagggagcctgttactcgtgtctgggtgcctaaaagaacctttaaatttgagaatgcttggtgtgtagaaccgagcattcatgatgttgtttctgacagctggttgtctagtgcaagtatgccgataactaagagactagatcattgtgcatctgatcttacctcgtggagcaagactactcgtaatggtttgaaagaagaaattgccgagtgccggaaagaattgaataggtgcagaaattaaggagcagcagttgatcctaatcgcttgtcttcattgagaaagaaaatgacccagttaatgattcaagaggataagtattggagacaaagagcaaaaactcattggtatcgtgatggtgatttaaatacaaatttttttcatgcgtctgctacctctcgcaagaaggtaaattgtattctttctttagaaaatgatgcgggaattcgtgtaacagatgaacagggtctatgtcatcttgctaaaggttattttgaggaactttttcttgaaaatcatagtgaccgcgtccctgtgttggcagccattgatagtgttgtgtcggtagaggataatgattttctaaccgctccttttcaggtacaagagtttaaggaagccatgtattcaatgcacccggataaatgtcttggtccggatggttttaatccaggattttttcagaaattttggtcagtgtgtaactctgatatttttagtgagtgttgttcttggttgaataataatcagtttccaccttcacttaattccactaatattgctttgatccctaaaggaaatgagcaacataatatgaaagactggcgtcccatagcattgtgtaacgtgttgtataagctcgtagctaaagtcttggctaatagattgaaaaatatcctccataaatgtgtttcagataaccagtcggcgtttgtcccgggacgctccatcttggataacgctatgattgctattgaagttattcaccatatgaaaataagcaagaggttgagagataaaaatgtagcgctaaagttggatatcagtaaagcctatgatcgcatcgattggttataccttaaggaagtcgtgattaaaataggatatgcaaaccgttggattaggtggattatgatgtgtgttgaatcagttgattattctgtaattgttaacaatgagtcggtgggacctatatttcctggtgagggacttagacagggcgaccctctttctccttatttgtttattttatgtgcagaaggtctctcagctctcatccatcaagctgaaaggagaggggatattcatggcatttctatatgtactaattctcctattatttctcatttgttatttgcaaacgactgttttttatttttcatggcggaagaaagagaagttggtgtgatgaaaaatattcttgagacttatgaaaaagctcttctggtcaagcaattagccttccgaaatatgaagtttattatagtcggagtgttcccgaccctactcaagactctatcacttccatccttggtgtccgcgctgttatgggaactagtaagtacttggggctgccatccatgatttgcagaagcaacttttggcttcattaaggaccgcatttggcacaaaataaactgttggagcagcaagtgcctttctaaagccgaaagagaagtgttgatgaaatcggtactccagtctattccttcttatattatgagtgtttatcttttaccaaacaagttagttgatgccatagaaaaaataattaacgctttctggtggggacatggtggcaccactagaaaaggtttgcattggctatcttggaagcgtttatctgttcataagaattatggtggtatggggttcaaggacctcacatcttttcatgtggcgatgcttggtaaacagggatggaaatttcaaattgataacactagtcttgtgtctcgtttattcaaagcacgatattttccacaatgtgactttttgagttctaggcttggccctaatcccagctatgtatggcgaagtatatttagcgctaaaattgtggttgaacaggtgttagatggaggattggttatggtgctagtattcctttgtttggtgcttcgtggcttaaagatggttgttccctctcaacacaaagccctctttatgcgtcacttgctcatgtcaaagttcaagacatcatcgaaccatcgacaaaggtttggaatgcaacttttaatttctaatttgtttgatcataatacttcccaacttattttgaatactcatttccatccttttgttcatgaagataaaattatttggaaggctgagaaaaatggtagttattctgtccgtagtgcatatcgaatttatgttacaaaaattgcagataactctcatttgcacgttccggggaagtggagttcgatatggaagcttaagtttcctcccaagattcgaaattttgtttggcctgtgtgtcggggttgtttccctacacgtgcacgcctaagtagtcgtggtattcattgtcctaatgattttgtcttgtgtggaactaattatgaagatagtattcatgtcttgttagaatatccaggtgcgatgcaagtgtggcgggaggttaatttatgggatattattgatagaactctccgtcgaaattataacatggatgctttgatattttctcttcttgaccagctgccttttgcgcaaaaagaattgtttatgacgatcatgtggagcttgtggaagcgtaggaatttaaaattgtggcaacaacaaaatgaaacatgtctacaggttgttgaatgggcccgacacctcttagatgattggagaaccgcccaagaagtcatatcacacaaagctacggacatccttgctcagctgaatagtgttattcatggtcctgtcatcgagtggacgaagtcggtatatggtaggtacaaatgtaatattgatgcctccttttctgactctctgaatatggtaggtattggcatatgcatccgtgatgatcagggtgattttgtcatggctaagacagattgtttctctcctcattgtgatgtcgatgttggcgaggctgctggacttcacacgacactacaatgggtggctgatcttcattatgacaatgttgattttgttttggattgcaagtttgttgttgaacgttttaattcaaacctaggtgatagcagtgaactaggttgtattattcaggcttgcagacaattgttcgattgtatttttagaacgctcatgtcgagttcaataggaggcaagccaatgaggtcgctcatgaattagttagggtagccccatctcatgctagctcccacgtttatgatgatgtaccgtcatgtatccgagacttgatagctaatgaaaagcaatgaattttttaccttaaaaaaaaaaaccattcttaatcgtctctacttaacgtgtgtttatgtctatccaatagggacctcactaatcatttattatatttctactaactaatcaatctctgagaacctttcaaaaaaaatctatatctgagaacattatttaaaaataattaatatttttaaaatagttaataaaaagtatttttacaataagtttgttttccttaatcagtattctgcagcacttgcttttcgttattacatacttttcaaagtgatagctcccaggcagtgtctgaagaattaaattaaagcattttaatttaattatgtgaaagatattaatttttttgacaattagttttgtgaaagatgttcaaggcgaaattacattattttagttaaattcatagtaatattttgctgcatacgtctcaaccaaaatagactacgacgtattacttgttttatttttgcaagggctaacacttgtcgttgtgaccttaccccctatcctatagtgattagatctttaaattttttttttatttttttttaggggtagatcttaatatttcttcggctaaaactatttcgatcaacaaagcaaacgcgttagatttggcacgctacgataggtccacgtcaggttcagccttttcgtcaatatcataatttgattaacaaatatgtcaataagccattaaatggattagtgaccagaaatatgattggcagtgagaaaatatggactttctaatgtataataagatatattcgtacacactagtggttaggacccaacccaatatgcatactcatgtttgaccatgcttagtttatagataatcctacaagcaaaataaatcctcaaatttaaatctttttaatgagagttttcgtgttcacaatggttttatctaactcgagagattaattttttcaacttcacgtaaatgatatttaattcatataaaataatcattgcaatagaggttatctaatatgcacaaatagaacaatcttgcaccatttacaaatgtctttttacaatttgatcaataaatctcatcatagatcatttaatcttatagggaggtttatgctcccaatgataaaaaagcattttgtgttgtctaaaacttaactcacttgtataccatagaacaagtcttataatagaaatgcttataaaagaaagacttgatcattattggagagcaaaagctctatttatacaaaagtacaatcacatatcatacgaacaaaatgaaacagaaatataaaagggagcagtccaaagacccaatacagtgacaataagatggttgctctatgtatctttatattgtgccaaccttaaaataaatcgattagactgcatcttaataaattttgtgcaaccgaaagttacattatgaaaaatcaaagagctttgaataaaattgagggttgaatcgtatctcctaatagctttcgagcaaaaatgtctaaaaatagcctaacacctacaatttgattacctataatttgattgtaacatcttgctgctttgtggcgttctataaacattttattgtggtaatttcttatgttaaaacccatattttgttatgttctagagcaaaaattgattttcttgttcttgtgttattcatcagattccctaataaaaagatcgttgaacccgtaaacacacgcaattaaaattcatgtacctttctttctaaattattcaggtcagaagcttgatagacagcaacatcaaatttccagatacacacgtcaatacacaataactccacctgtaatgtcggccaagagggacccataatccatcatcatttcaaatcttttcctcactcctccttccttccttcccccaattacatttacaaatccacaaaaacagataaataaatttagttacagcaaccgtaatcctccacgtgtccataacgaatcttccccagttcctactcatttcctctaaatcctagtcaaccaaatatcttaacacgtgtccactatattccacagtcagcaacaacacacgctcatgtccttctcttcctataatataaccttaccttacactatccaagttcaactcaactcaaaacaaaacaactatagtgtattattatattatgaatttgtttgtttcaattcaataatgactagtactcatcttactaatcaaagggatcgccgtatcctatcattcccggcggttcacccttgcgaaaacatatctcccacaacactcatcacttctctaatcaatctttcacaaactatatccaatttccaacctcaaatattcccaacacaaaaacgtaacgcaagagaaactatacgtcaaattactataatttcaattttcctcaacgaaattaaagaccatggttccattattcctaactcaattatcctatgcttttcggagcttcacttcactttacaaaagattcatttcttaatgcaagattgtactttagaaggttctagtctcttattgctcgcgaaatctcaacacgtggcgtctcagcttcgttctcttattcgcgcagtggctattacattagatattttgcctttacacagagtcgaaatttgcgacgaagtcaaggagttagttgaattggtagctaaacaagctaggaaaggtaaattcgaagtagaccccaacgacgaggttgcgtccaaaaaacttcattatgttttgcatcaattcgagagaggaactgaaccaaacttgaacaccatgcatgaaatccttcattaccttaaaatcaagagctggaatgattgtgacagagaaatcaaattcttagaaaacgagataagtttcttggaggatcggaactgcgacgaacgagaggttccgttgttgagttctttgattgggtttttaagctactgtagggcagtgatattcgaagattttgatgaaaatttgaataaactcgaagctcgacgcagcacggagatgataactgttaactgtttgaatccagaggattttcgttgtccaatttcactcgaactaatgactgatccagtaacagtttcaacaggacaaacctacgatcgtgcttcaattcagacatggcttaaagcaggaaacaaaacatgccctaaaacaggggagaatattaaaaacacagagttagtcccaaacacaacgctgaagagacttatccaacaattttgcagtgataatggtatttcattcacaagattttctaaccgtaaccgtgacataacgaggacgattttacccggtagttctgcagcagcacatgctacgcagtttctgtcatggtttctaacacgaaggctcgtgttcggaacagagcaacagaagaataaagcagcttacgagattcgtttgttaacaaggtcaagcattttcaacagagcttgtttgattgaagttggaactgtgccaccactgttggatcttttagctacggaggataaaaccactcaggagaatgcaatctctgctttactgaagctttcaaagtatgcaaccgggcctgaaaatataatagaccataacggtttaaagcccgttgtgtatgtactgaaaaatggacttagtcttgaagcccgtcaaattgcagcagctataatattctatctttgttcagtgaaagaatatagaaaattaataggtgaaaatcaagatgtgattcatggtttagttgaattggctaaagaaggaacaacctgcggaaaaaagaatgcagtggttgcgatttttggacttcttttgcttcctaggaatcatcaacgtgtgcttgaagccggtgctgttcacgcgcttgtttctattttgaataccttgtgcaacaaggaagagcttgttactgaaactctggctgttcttgcggcacttgctgagaattttgatggagctaatgctgttttggaagcttctgcattgccgttgattactgggctgttgcgatctgctccttcgcgtgctgcaaaggaacattgtgtttcgatattgttgtctctatgtgttaatggtggtgttgatgttgctggtgttcttgctaaggatgttacacttatgcctttgctctattcgcttcttactgatggtacttctcatgctgctaagaaagcgcgttttctcattaaagttctgcaggatttcaacgaaactgcaacttctcgattgaaaggttccgcaattctacgccaattgaatgtgttagaacttagaaattagaatctcttcttgtgaatatatatgtatacttttttggtgtatatactgtaacatataccttggttattgccacatttgagaatttgtggaattagctctctgtatttttatctctagtgagctaattttaataagtgagcttcaaattatacactggaagcttatgattattttgtatctggtatagttaagaattaaagtggtgtgaaatcaatgaatgaagtcagtttagattacttcaagttcttcttttttgttttattttgatattttcccaaattaacaaagtttagttcctttgaatgcatgtgtaatgtgttcaagatgatgttgagactatttaaaaataggatttatacaaaagcgaatttatttaaaagaggagtgttaaattatgttccaattctatgtggaaatggtgtggcattgattgaacatctaagtatcgtatagaattctaagttggttgcaagtttctgatcattgggaaaactcaattgagttcatttggtaaaactctgttgcatatattgtaacagtactatcatgcatgtgtatacttgtgtgctaatcaagtgtttggagctaattagcatgactcacaagtattgtaagttaagccatacttcatagtttattatagctctcggtgcaaaaaaaattactaattttggtcatttctttgctgctgcgggtggaattttagtgtgcactgatgtggaagtttattggggtttgttgagagttgtggagaaatgtaggatatttgagagctgttggttgagagttgttgtgcaggagaagagtaggagtccaagagttgtggaggagaagagaagagtaggagtccaagagaattgagtgatatctgcataagatgccgtgtctgattttgctacatcttttttggtttagcacgatattggtacgaaattttcaccgcttagcagtaattaatttcgttgggaaatatgtgagagtcaataattaaactctgaaccttatgtttaaggagcttaaatctcttattacttggatcaattatacttttgtatttggcattgtttatgtttaataaaagtcattttattttggatcaattgaaggattgtattttttttaacttttatgttcatcttatttgtcattcctcttcccaaaagctttgttaacagacccatatagccattttgcacattacaattgagcaatgatgtggtagtttcccacattacttgggtctgagagcgcgtgtgcagataccaccccttccctctcaccggtaacggggcacttccataatttccgacgagatcttcgacaataaaacactttcttcatcatcccatcgtattaatgtgagtatcattatctttcttgagataattatttattggacatatcaaaacttaagtggcccctatttacatggaccaaagacataaataagcatatcaattttattcatattagtattcaaagaatatgttatattggcttattttagagcttatacaaataaataagcattaatgtattatttataagcttgttaagatagtttataaaaaaacaacttataaacatacaattttcgttaataaaatcttataaattaaacaaaaaaaagcttaattatttgaataaactctttttcacacgctcaattcaaacatgccctaaactgatcgtataagtagataaattttgagtccacgttcacactaacttattagagtacaggaacttaattgatgataacttgttaaatataaggactaatttaacaatttagagtcttcatagacaaagactttcagataattagggattagtaaacaaacacttcctcaaagacgtatcactatcgttaaatcgtgcaatttttccaaacgagcaatgatatttgaacaaccattttggtacaacttttaggacaatctagttgttctctcttctcattggtcaaaaacaatggagagagaaaaaggaagaggcagaataagaagataaggtgagtatgagagagaaaattgtataaaagttgtgttgtacaactatcatttctctttccaaattttacattaggtttctgcgatttgggttaatccaatggcaaccaagccaaaaccttccaagaacgtcaaggttgatctctttgaagacgacgacgagttcgaggagtttgaaatcaacgaaggtaacttcaaatcgttccaacctttaacccctcttcatcccaattgttgtcgcaatcaatttcagtttcattcaatttcgatccatatttgaatccatgttagtagcttcttgttgctgttcactttttcaatttgatgtaacttgcagaatgcaagggcaaggaggaagggaaggaggtagctcaataaaataaaaatgaataaattatctattaaatttgacaaaatctttaggtgtttttcatatgattcttaactaaaaatataattttcatgagtagtttaattaggaatcatatgaaaagcacctaaaaaaatacacataaatttcttgctagaatcaaaataaggatataacctaggtgtattttcttaaatgtgtttcatgtggtattttacataaaatactcacaactacctatgatttcttaaatccgcaatttttttcaaattgtttgttttaaccataaaaaatgaattttaattatgtgatgaaccaaacaaaaagcatgtaaggaaaatgcatcaaagttttgttcttaaaataaagaatttattaatgacaaaattagcaattagttgttaaaaaagaacataaagtatgtaaatgaattaaaatatcaaatgaatataatagtaataatagacttatgaaggaaaaataatagtaacagcagcactaattagagatgccaaaaaaatatggataaaatcgaccattaacatgaagtgaatagcttaacatgcacacaaagataaaataaattaatatttcaagtaatttaaatgaatggatacatatgtatagtaatggtatctctacagacaatttataatgataattaaggcgtgcaatatgtgtagagatattcatacaacatcaattttttaattaaaaaattgttaatgtgttagcatagtacatgtccataataaacaaattataaaattaaatattatgttttgagagcttttccatccattgtgatcctaaccaacttcatatattagtctgtgcagttgcaagcaaacaattttcgatttacaacaaaaaaaaaaaaaaatagaaaaaataagaaaaaaaggtaaaataaaattaacattggagtaacacacttatgggaggtacgcctctcaatcagggtggttctttcatatctgatgatatcctttggaggaaggacgttccgttaaaagtctctatttttgtgtggcggctttttcgaaatagattgcctactaagaccaatttatttcagcggggaatagttcattatgaggatcaattatgcactggtgggtgtggaatgcaagagacaaatgatcatttattcttaaattgtggtttctttggccaggtttggaaaatggttcaaaagtggttagggtatacacagctttcgtctaatacttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtatggatttatgtagagagttttatttgtgtgtagtgttatgtaggtaatttttttgtatttgtataagatgtagtgtgttgaggtggttgttgttttgaaggagattgaggtgatgtagagntgtaattagttattggttatggttggaagatgttgttgagatttttgataagaaaaaatatttttggaatagtaagtttttgataatttgtgtaagaattgatatttatgtatggattgagtaattattatatgtgtgggtgatttgatggggattattagtgttagtattatttggatatttaggatgggataaaatgtgtatttattgaaatgttgtgagttttggtaattgggatgtatatatgggagttggaattatgagttgtggggttagggattttgatttttattggtttatgttgatatatatattaggtggatgtgaatgtgtgtagaggttaaggaggtgtaggtatattgattatgtgtgtttagtgttagggttataagaaggagtttgttagagggtatttatgagagtatttagattagagtatgtatgtattggagaattagaggttagtttatgaatttaaggtttaaaagaaagagtgtatgagaatttgtgattgtgtttttgttgggttaatgtgtgtttggttttttttgtgttttgtgtgtttggttgtttgttgtttttgtttttttatttttttgtgtgtgttaggggtttgtaaaaatatttgtaaaagtataagagtttattgggggtgggttttttgttttagtttgggatatttttgaaattgnnngngggggggggatgtttgggggggnntannnnnnttttttttaaaatggggggggcaaaaacccccccctcgggtttaaaaaaaaccccgggggggttaggggggccaaaaacaaaattttttaaaaaaaaaggggccattttccaacaaaaaaaaagttgggggcccacccccaaattttttgaaaggcccgggttttaaaaaaatttttcaaaaaaaaaaaaaaaaaaaaacatgagacattttagaactaaggcatatttggaccaaaagtggaaacaaagacatatttaactattagtactttttttgtcgaggggactttttttattagtattgatcttcggcttatggtaatagtaataacacttgactttcttctaaatcataaaatttcaacaaaaagtataacaatcgttgaaaacagtggtgttatgttagttagatggttagcacttgacttgtggtaatagataaatcaataattgaaaacacttaaaatgaatagggaccagtggtattagttagattgttactatgttagacagtgaattccgaagaaaaagaagtttgttatggctagaatgcaggttcgccggtcagcacttcacacttgttgcggtcaagaactaaaacatcacccaaacttagataagtgtccaaatacctatttatggcatattgcttaagtacacatattaaaaaattatttagcttccttcttcaaaaacaattatttagcttccctcaaaaaacaaaaaaatatatatatttagctatcaattttcatttgcattcttcatttgtttttttttttttttggagaaacattcttcatttgtttacatcgtctttcttcagcttcttctttgaattttgcagccatggtagacacttatttaataagaaccattattggaataatcggttagtgcagaaaaacctctggcttatttcccctgtttattccttctttcttgttctatcaagttgttaaacttatacaaccctaagaagtatcggcaccaaccgcagacatgataataatttaagaaaacagaagtgatagaatgtaactatatgtgttggtgttgtgttaacgtcaacaccattgtgcccaatgtcaaacatcaaacatgctttaaatttgatattggtgctacttaacataacaccgcattctttctcaatatttttatttggtcattttgatctaaagagaatgatcaacctagtgtgacatgagtgataaatatttgaatgcttcaatcttgacttatatgtggagagagatcaattctttaaatgagtttgagttagagtttgcaactgcatgcagggataatctaattttttttgtcaagtaacctagtggttagagctcatacaattaaattgtggagaagtggagtgtacgggttcgaaccccgacccctgcatataatatgcaatatccctaccaactgagctaagctcacgggaatagggataatctaatttgacatcaagattgtagggaaaaaaatgaaagaattaatttaacacgctttagaatatcaccatacaattttatttttgctaatatatggaatgttattttatttgcaggaaatgccatttcttttttgttttattcatgtcaccggtgtaaatttatctccctctttctctttatccttgtacttaatttaaggattttagcactgataattaatgacaaatatgtatttctaatatatacgcaggcctacatttataaaaatatgcaaggcaaaatcagtgcaagatttcaaaccagatccgtatgtggtaactatactcaattgtgcaatgtggtcattctatggaatgcccttcattagtaaaagtaacactcttgtcctcacaattaatggctttggcttcttcattgagattatctacacttccatcttcttcgtatactcaaatgggagtaagcgtgtgagaaacatctcaaacttattaattaagttacagtctatttttcctttcaatgttttaaaaatcgaactgaaggtcaaaccatgaacattgtctatgatatgttcagttacttaaatgtaggattgtttaattttggttcaagcgatttaaaccagttgaaccatgatccaaaagtctgaccggtttgatgtcaagttcaatttttaaaacattagttttttcacttaacaattgatcaatatttctgattctataatttttgttctaattggttggtggattgggtgaattttaatcaatttcagaagaagatcttgttggcccttctagctgaagttgtattccttgtcttagtggtatttattgtcatgtattttgttaccaaccttaaagagagaaggttcattgttggagttatatgcataatctttaacatccttatgtacttttcacccttgactgtcatggtacgtgtgattattcagtttcttaattaactagtttcctgccaaatttgtgtttttggtttgtataatagcaattactttggttgttttatttttgttaatttgcttgttttttttttttaattttcacaccttaaaaaaagaacagcgtcaagtaattagatcgaagagtgtgaagtacatgccattcttactctcactagccaactttgccaatgggcttatttggacgacttatgcacttcttagatgggatccattcgtagtggtaataatctatctatcattagtcgttattattgttaaatttttgttctaaggatctatatattctatttaactttacattttatttgagctggttagtcccttggttaagctttgaaattaatcaaatgatgcctttgtagtttacgattgctaataaaatgtttgaatgcatagattccgaatggattgggagcactttctggattggctcagctcatcctttatgccgtttactaccgaacaacaaagtgggacgatgatgctccacctagtagtgtcaacaatgtatgactacagcttggattgacagaaagaaagaacaagttcaaaggaaaaagttgttcttttagtacataccaaggtctcttggaattttttctttttctcatatttttgaaaggaataacttgtttttatattgtaaagtcatagcactgatctcttgtagaatagaataagttgagatcattacagcgattgttgtggacctaaacgatgtacatgtttatttgagttgtttgtttgagttagcctagatttattagaagagtgtatcataatcatcagatgacaaaaataaatatacatttcataaattattcacagttcaatacttcattgaaaaaacagaaggttcataactttttcttttaaaactcagtatccggccgaagaatcgactaatttgaggatcatggatcaaatgtctaatcacatgcttataaaacttgattatccgacgacaaccataccgcattactatacgtatacattttgacttcattattatattgccattaaacaggaacaatgaaacattgatattgaccttattttctccccattctatatcgataaacactaattataccagtcaaacaccattacccttttgaatactattgggattaagttcggatgatgaaagcaaggagagattagaacaccaagccaatgggtccaatttaatcacatcaaatatgattgcaagtttgcaacagtataatatataatatatagtataatgaagatccagctgggaggcaacattggctgaaattaatacccatacccacaaaactcaaaccaagtggagaaaaaaaggcaagagtaaaagaaaatcagaggcaccaattcctccaacctatacctgctactgtgtatctctctcatctcattacagtatccaatttttgtattctcaccatagatacaaatttgattcttcaaatagtgaaaaaccactaaaaccaaattgtttgttgtcaactaaagaatagaacttcatggtcctctatgcttgcgaaagcaaaaacaaccctgctgctgatcaatagggatcatacctccacctttggatgtgtcaatggcctccagcatggtaactacctcatccatctctggccgcttatcaggactggcatcccagcatttcctcattacgtttgcaagagaacttgggcagcatcttggtatttctggtctcaattctaaattccaacagaaaacaataatgtcatcataatggattcacaaacacagaatccactgcaattataaatatgaattgcttacataaggcaatcaactgaaacaaggtagcaagtatacctggcgaacaacagctgaagtaatctctgagaaacttaggtcaggatatggcatgtcacaacaatatgtctcccataaacagataccaaaactgtacacatcacatttcctgttataggggtttccatttaaaacctgtaagaagccaaccccattgggaaaaaatgaatagtcaattacaacggctttctctttgaacaattaaatattaaggtaatcaattattctcattgaagaactcttagaatgacaagggaaaacagagatactcacccactcccaataggattaaattggggctaggtatatccattctccatcagacagaaaattggtcctctcatcagaatttattaatgagtgaagaaagagatatgcacaattttcacaggatatctatctcttcatacgttcataaattctgatgaagtcttattaaatctttgactagagatagacaaagttattacaaaataaggtcaattcaaattttaacaagaggatcttgagacactgcatgcctttacaccaaggctcgttctctgttatacatgccagtacaattattttgattgaatgtttcaagtcctagtaaaatatccattttttgagtgtagtcctagtaaaaattctatccatttttagtccatacaatttatagaaacataatacatttatagggataaacttgaaagattcgtaattttatagggactacaaacatatttaacccaaaagattctacaggtactaactacacacctctggagccatataaccaagggttccggtctccccggtcatatcattaggatttgacgcctcgactcgtgcaaccccaaaatcagcaattttaactgtgcgggtcttatccagcagcatgttttcggtcttcacatctctgtgaacaatcttctgagagtgaagataactcaacctgtaaaaccaagcgagtggttagttatatagacaaatgattggtttttttttttctaatctgctaaactcaattaaaatagattaccctcttgctaaatcaagcaccagctgtatgacaaccttaaaagctaatttcctcctcctgttctttattaggtatgatttcagtgtacctccagcaagatactccacaacaacacaacagatattgcttggcatgccaattagaccagtatcagtttgaatctgcaattctgcagatcccatagttgctccaataaactaaacatagaaacgagacgctttcagagaagtacataatacagattggaaagagaaaataaaaaaaaaacaagtaactactaaatatcacaaataatatgtcatagaacaggaaatagaatatgtcatgaagaaaaagagcaaatagggccataggggcttattatacttgttttgtgtacctgcatgcatcttttgcttcagaaaagggaaataaaagaacacccaccctaccaaatggaacgactttaatgcagagaagatatacgatatattttcattggttatgatgatgaggacaaggctaaagtgcattgagaggagaaaatggtataagacatgcatactttcaaagaacagactcaccataaattgtaaaaacccgaaggcttgaagctttcattattgggaaatttcaaaacatgcaggagggctggtttattatttacaagctttggtcagcagcaatgaggatgctgaaccaaatagaaaatgcttattcaaatccatctttatcctctgatgtgaaatactagttccctattagatcactctgaagttgtgaccatttatatatagaatggtaatcatatcaaaacggactcttttttatatgaagaattcggttttcattcatagaccaaccgagtatctacacagattaacaagatatgaattaagtcatatactttacttttatgtaatagctgcaaagaagttacttatcctctattcctgtattcaactttatgataggtaggcaattcgacagagatctcaaaattgctttcggaataataagaaagtaaaactacgaatatgtaaatatacattcaactatggattatctaaaaactgtagaattcaagatttgtagcctgttaataaggaaatagtatatgccacaagtgcttgaatcgtataatatttctctgttgaatcaccacgggcagactcggattaatccattgcaaattacatattgcaacaatctcattctatatcaccccttatcatcaaaactacttttgggttccatattccaacttatcaacgtagaatcagaaacaataagagaggcatatctgggacagtgaaactcatatgttgtatataaagttcaatataatatgattcacattctttagtttccacaaaatagtagaattttttatattttgcaaataataaaactttacagtaaccaaaaaaaaaaaaaaaaaactttaacataatgtcattgcattgtgcagcctgcatagttcatgctccttaaacaatacgtatgaaacttttccacacaatcaggaaggaaatccctaaaagttacatcacttccacctaatcacttgacagtgattatcactatcccaaaataaatgtaacccaaataaaaatcaccattacaaagtcctgataccctaattttttttaatttcttcttgcctgcacagtgttttatgctcacttttttgtggtatatgatatatgacccgttgaaatttggggcctaactcatccttacaaaaccggcttgtaaggtgaggagtgcctcctctttatcaacttttctcaagagtcctatctatccgatgtgggactaaattcacccctcaaaaccaacacaatgaaggtgttggaggctgcaatgaaggcaaatcaaaggccgcaatttaggcgactgggggcagaccgcaatgaaggtggaatttccaacacacccctcacgtttcagcccggcccaatagacctaaagcgtagacaatgtgggaagcccaatgatagatctaggataggctctgctgccatgttgaaatttggtgcctaactcatctttatagaaccggcttgtaaggtgaggagtgtctcctctttatcaactcttctcaagagtcctatctatccaacgtgggactaaatccacccccttaaagccaacacaatgaaggtgttggaggctgcaatgaaggtaaaccaaaggtcgtaatttaggcagctaggggcagaccgcaatgaaggtggaatttccaccatgaccttatgatttttgcttacgtaactgatttttccttttagttgccttttccagaaaataacacccttaaaagaaagaagttgatgaatcacaccccgaataaatgaaaatactaagcacataacactaacatgcaacattaaaaccaaaagctcatcatatataatttacaaacaataaaaacataagaggctgatgttgaataaaatgaaatcaacctttgtgacattgggatgatcaagtttatgccaaacagcaacttcctgtataaacgctgccctcagggaggaaacctcagcttctgtcctttgaccttcttcaccccagtcaagcaatttaactgatcattaagcaattacaatccattatcagtaaaatccagaaaatgaaacctctaactcaatttcaccataagaacatccaacaaaacaatagcatcaaactttctaacatccaccccatcataagaccaagaccaaaaccttaaaacaacaacaaccaagccttatcccaataagtagagttgactaaatggatcaaaaaaattttagaattttctatcatatctctatccaactctttctttattggaaactcgaaatctggctcaaagaccaactaatttggggaccagtcccaccatccaattgaagtcagagcaaatctttgcatggactgatcacgggaactattggcacctgggggattcaattctggcatgtaaagaggagcacacttgacaatcctaggtcccaaacattcaccaccaagtcaactcaataatctctatgtccatcctaaaaacctaaaaacatcccccaaatagatatcattcctacaaattattcaaactcactaaatcatcgtaaaagtcaactcttttcaagagaaaaattatttttttaataaaaataatacaaatcacacgaaaatataatttcaaaaggattgagcatctgaatctgatgagtaaaattcatacaaaaaaaaaaaaaaaaaggaaacaaaccagcaacatcttgagtatcataaacaccacgatgaacagtgccaaaagtgccacgagcaataacacttttgatgatgagtttagaaggatcaatttcccaatcctgtttttgcttcttgaagttagttttgaacttaatagatgtaggagaagtatttgcactgctggtgtgaacacgaacatgatcaaaaacagaagcagaagcagcagaagaatcttcttcttcaacgcgcttcttcttgtcaatagtcaacaccttgttgagatgtctttcaagctgttcatcgatgcttttcagatcaatctgatctgctcttacaaacccatcactggtttccttcatcttctgagagaatctatggatgatgattgattatgggtttggtgagaaaaagaagaaagtgaaaataaagatgagattttttttggggtttgagattgtgttttgagatgtttattgattattcatcatcatcgtcgtcgtcgtcttgttgttcttcattcgtttgttctactattaagctctatccatgtgggcacatggaattgcctgctcaaaacgtgtgcctatgacccacttcactctcttcttctcctcttttacctttatcttttactacttttgtattttctagatcatataaattttcatgtattattatagaagtaaatcacttgattagtctttgactttatggaacactctcgataggagagtatgggtatatttgaaaatgagaatgctaaaaatgtttcaaagagtattggtgaagcatctaaatcaagcaaatttttataaaaaaaaattgtgtaattattacataattaaaagtaacatcttatatttttaagataaaatttatattcgtatattccttaattattgttttgaagatactggttagcaagactcattttaaaagagaaatattagatgtacattcttttggttggttatctttatacatatttttagtctctatattttaacaacttattcaattttatctttaggctaaattttatttttggttcgttaactatttatgtagtatcgttttgatcccttgattaaaattcgatttactttggtcccttaacttctttttgttatacattttgatcctttccgttagttttaattcaaaaatgttaggttttctttatcttcttctcctctttttcatcttcatatcatctccatcaaccttcagcaacaagaataccaaaaaaaaattatagaagaaaatgaagaaaacctaacatttttgaattaaaaccaatggaaaaggaccaaaatatgtaacagatagaagttaagggaccaaagcaatactacataaataattaagggaccaaaaatacaatttagttttatctttaagattacctacttattataaattagtcgacatattcttttaaaaaaaaaactaacagtagtgagtaaaatttgatagatacaaacttttttaaaattctcataaaattgtagacgtatttaacggtgtcctataatgtcagtcgctagtgagaaagaatgtaaaatctcatggtcatattcgagtcaccacgtttcccttttcgttgtgtttttattcaatggtcttgttaacgagtgttctatgatacttcttaaacatcttaaatttaataacaattatttttttaaaaatcaactattacaattttcaatgcactcaatatacaattttttataaaaaaaacttactaataaaagtgcttaatgtaacgccctattttaatatttatttattttattgagtttagagtctatttttatgacttatgcgatttatatgatttttgtgatgtgttgttgatttattaagtggcttatttttattatttaatagaataagatttgaaaataaaataatattgagatgaggggctgttttgagaatttagagagtttagtgaaatatgtggaaatattatgttacttggtgttgaaatatatatgttatttggtgtagaaatatatatgttatctagtgtagaaatatatctgttatttggtgtagaaatatatatgttaatttatatcaaacaaaattcttaaataggacccactaatcaactatcaataactttatatcactatattttaatttttaatattaaaagagtgtgggtcctgcttaaaagtggagtcttaagtaagaccccggatcttataagaccgtgaaaaagattctctccattgggggtacctaataggttccgggtcttaaatagttaagaccctcccaatggagatggtcttagagcatctacaatggtgaggtcttcattatttaagacctagtacctaataggtactcccattatgggaaattttttttgggggtcttctaagaaaggggtctaacttaagacatctttaagtggtccccacacactttttttattaaaataatatgttagtggtggaattcaaatgattaagagttagtggtgggatccatttagactttttgttagaagatctccattggagtgaccgagtacctattaggtactgttattgtaaaataataaaaaaagtgatgtgtacaagtggaacccgcttaagaccttcaatttaataaaaatattcattgatataaatcaaataacattgtatatgataatatttgcatttatatattagttaaaaaatacgatcaaaataacttatgtgaaatgtttgagtttcaaatctgatctatatattaaatgtctatgcccactttgctaaactcgtaattgtcactttagaatatcaatctagcatttataatttttttactataggaaatcttaatttgtgccctcagacacaagttaagaaaccaaagatagaaacattttgttgaaaattgtgcatttaatattctaaaaattttaaatcttatcttttcaagacataatttattactccatccgtttcaaaatacatgttcaagtcaaccacttcacatatgccaatgcataattttgactgttaatatctttaattttctaaagtaaaaaattataaaaatttaatattttgaaaatatttgtcgagacaaatcaaacaacatcttacatgctaatatttgtatttatatattagttaaaaagtatggtcaaagtaagtcaagttaatagtgcacattgcaaaaattgaacatgtattttgaaacggaaggagtatttaattacatttttagattcttaacttaagggcacaagttaatactactgttttactatttctcctatttattgaatttcatcaaacttaactattctactgactacaatttttaatttttaaaggtatttacataacattaaatttatcattaaaatgaacacaattaattatttgcttaacaatcatatgtagaaacccttcaaggattattatttgagatggagggagtaattattattatttaatttttaaggagattgatgatgtctttttggtggatgttgcttttgataaggcagccagtaaacctcttcctccgccattaaaatgcgatagcaaatagaaaatgctattagcaccaaataacacgtgtcaaaccctttcattttctcacccagaacaaccaccatgtcttcctcccaaacaactcaacaacctcctccaccgtcgccaccttctcactacaaccgcattcaccatctccttcaacttcaacctctcttccaaaacctcgcttcccatttcagaaccagtagccattgccagtggacttttcatcatgcccccaccacgccttaaaaaccagtactatcttgtgaggtctggagaatcagagtttgagagcatgggagtgataaacacgaaccctgtagctaagacttctatggataatggtttatctgatagagggaagaaacagagtattagagctgcttttgatttgaaagaaatgggtgcttgtgataataattgttggatttggcctgctattactcagagagcttatcaaactgctgagattattgcttctgttaattctattaccagaaggttcttattttgcttttgtagttattcttgttaacgttgatgatgtgttttttggttttaattttgggattttgaatttctttgatttcagttatattgttccagaatacagctttcttgatgcacggggattaggtgcttacgaaggaaaaacattagaatatgtttcaaaagtaagattttcactccatggactcttttatttactttagctatgttatatgttgccttctagttggaaaattgtctcacgcagactatagtatagtaggttgattcttgcaaattatttgaaactctaataataattgttgtcagtcctcctcctaacaagaatctcatgtattactcgtcctggttactaagaaggtgattcagttggtgttggttttacaaaaaagaattttaatatctcgagttgaaactcaactcaagtttatatcctgttttcttttgtttgtgtcgaatcaacattgatcagatcactatcttattcgtaagaaactaaggacacgagaaccttgaacttctacttaaaaatggcaatgtcgatttgtcaaaattttaagcgattttcaagtatcaatggaatatagatcgcatgcctgtaacaatttcacagtctaacttatatatgtttttcattacaaatacagttacaatttcacttattgttgtggagctaagtagaatttttgcaatgagattaaaaatgtgtgtaatggcgggagtgtttgaaatggtggtacagatatatgcatcagatggtatatctacaaaaataaaacctcctcccattgatgacggaactccaaatgagagtgttgcagatgtttttgttcgtgtgactcaactcatgtcaatccttgaaactcagtatgctggtgacacagtcgttatagtctcgccagattccgataacttgtcaatccttcaggctggtttggtaggactagacttgcgaaggtaactaaccgactaactagatactccaacctcaaccaaccaaaacccctgcaattatatatacgtgtatgattttaattctgcatcacattcatttttgtttcttaatttactcgtgtctcaaatttcaggcacagggagttgtcttttgcacccggtgaagttcgctatgttgataccaatgacattcctacttacaagatgcctccatctgctgtatataaatgcaccaagctaccaaattgtaattagctcttttatttccttcaccttattataccagataaatggacatgtatagctcaagttgtgtacatctgtgtttgataacatcttattgtaatactttcctgacaagaaaaataaaattgttattatgttgattaaaattactaaagataattggaaaaatgagagttcatcaatatgagtaaaatctttaatattatgtttagattcatgaaaatgcatggaatagaggtgaccgaaatgatattgaggagaaacaaatatagtagcaggaggtatcaatcaagatatagcaggatttttgtatatcagtagcagcgattttctgttattggcaatgaagatgtgtggtgctagttttgtattgaaggatattgccaaggcaaataagcaaagcatgattttggtggccataagcgttgtgggggagattacttgtctttcagtttggtgtgtgtagtgtgtagtggcagtccatcgataatgggtgtgtttttatgctgagatacaattttggtttaccttaaattcatcatttgcttgttgtggtacgttttttaatggtactccctccgtttttaaatgtaagcaaaattgattttttttgttcatttaattaataatgcatgtggtctataatatgaaccacatacatcattaattaattgaatgaacctaaaaagtcaattttacttatactttgatacagagggagtaacaatgtcttttggaatcatttacgcgatgtagctcaaacttagaaccctctcttattagattagttggagaaaccatgtaagttgcacttattttttttggtcaaatggaagttgctattgatcgctgtgattaaaatttaataactcgcctaatgaattgtaaacgaaattattgccattcttcaccaaaatttatcatcccctctaactaatattgtaaggtttagtaaaaaaaatattaagtttactgcattttatttgagaaaaatatttaaaaaggaaggttagaacatccacaataacaataaactaacaaggatcttcgagtggatcacacttgtacatgtaatttatttataacttttaaataaaagtacctgttaagtacttaataatttcaataatattaaattacattgtaaaactataacctaaataggtaatacaacaaaatttttaaaatgaaaaaagaagaagaagctaaagcaataaaaaatagagataaagtgatttattattaggtgagatttggtggggaaatgaaatgtaatggtggaaatagtggagcatatagaaattgaaatctctcaaaatcgataccaaaagtagacaaaaggtaaaacgtaaaagtatcctcaatgcacagagtgaagggagtaaatgcgagtgtggaacacgcaaagcagtaaaatagaagtcaatgatctaaatctgtgattggcttgacggtgcggcgcgtgttttgttacttcatcctctctctctctctcatacacacacttgtgctgtgtgttgtgtcactcttgttcgctttttctattaccgtgttcctgctttattcatcatcctcttcctttacttcacttctttttttctcctctattttcttaccaaacatttatactccgatttaccgaatgcattttcttcttcaccgcgatcaaatcatttcgataagactccttatttcctctagggtttccctcaattcaatttccatggctatcagaggcgtcgatttcaagtggttagtcttctctctccctctctctctctgattccaataatactatttcctctcttatcccaattttgattcaatgcaactttctccttccaggtacgatggattttcctctccatgctcgccaccagcgtgtatcctttttcaattcgccttctctatatgcatttttccccctaatttttccatcatttcgcattttttactgccatatagaatgcttgttttttttgtactttgaatttagagttattgttgcaatcaattggaagcgctatcattcttgtacatacccattgcatatatggattgtggtgggtttcctttttaagatcattgcgtttttagctcctttgttaagattatatcgttagtcatcctattttttttttccacttttcttcaggtggactacactgctgtgttcgttttccggctcttgatgtttgtcgataacggctttgccgccggaatgggcttgtaaggccttacatcccattaacttcgatgttcttgttggttatttcatcgttttctctattttatactgtttgcatgcattagtgtggtgtttcagtgttttgaagtgtttcttttaagggttcaaagacttttaccccctgccatatgggtgcatttttgtttgccccctagaataaaaaaaaaacttggagattcccccttgtcattagaagactctcttagaagattatctggtttgaaccctaatggcatattactggacaaatatgatgatgtggcatgatgattgtgtaattaattttcttttttaatattttcgtttaatccatttaattgaagataagacatatttgaatgtacaataacctgcactctataaccaaggttcccggactctacctacaatgatcacaagttcatataaaatattgacatcattgatggtatcaatctgtatgccattagtttacctgtgttgacatagtattagatgataattttagcatgagcggagcatgatgaggccatttagtcatttgcctcaaaaagattaaaatttaaaatagcaaggaagggaagagacgtacacgtaaatgggagataaatggactatggtcaatctggcctatgattttaataaaaaataattttcatttatgaattctggaagttgagttttatatggttcgcatgatttctcttgcctgttcagcattcacgtggaaaagcatttgtggtcgttttgttttcatagatgactttgatttcatggtagtaagctcaactaaatttgttatgtattttttttgttgttgcatcaaacaaaccaagtcaaatgatgttttaatttctcaaaccccggtactaattcatctgtgcgttattcctccttcgcttctagggattttgggtggcagcagagatatgctcgtttctgtggtagagtggtcgtcctttcaatccttggattgcttctttatccatttctttgggcttggactataattggtaccatgtggttcagcagtgccaagagctgtgtatgtttatcatttaaattaaatttaaatttaaattcaatcttagttctactcttgtcaacaagattatgccgcataatgcaaataatcatctgcagttacctgaagaggggcagaaatggggattcctaatctggttactttttagctactgtggacttctttgcattgcttgcatgtcagtagggaaggttagtggcggcgctctattaaccattatatgtttctttgtcttgttaccatgtaacaatctctttttactccatttgccgtggtgatcttgttctgaacaatcgtaaacatagaatatctgcaaaataatattcaccatcattatttgatatctaggttgttgcagtaataattttggcttgtttaaccccttgcagtggttgactcgacgacaagcacacttagtgcgtgcccaacagggtatccctctgtctgaatatggggtaagatttgccttcattgcaacataattagctgttttagttacatatcttgtgaaaactgtatctttttatagcaggtatatctaaataatgtccttaataacatggattttctccccagaattgtccccctataaagaaaagggcagggagtagcacagtattttaagttctatcttgaatctgtactggtgcagtactgcagtcaatcattattcatttgttaacatttggaataaacttgtaatctgacgacatggtattgaagcttgcttatcagctggtgccatgctatctgataagggataatacactattagggtgtgtttggatggagggattatgaggggagggcttatttttcttttttaaattatgaacattataaaatgatttttagaaaattgaattatcaacatgataaatgatcatataatacttcaaaacacttaatttattttaaaaaaacattttacattgttcataatttaaaaaataaaagtgagccctcccttcctctcctagacccttagagtatgggtctatgttgcttttttacatattagtcttgtttttattttgttaaccatgacatagtttcgattttatgaagttaaactgatctagcaattgtgtaccctgttaactgtcatgttggacattgcttggtaatgtgatagattattatgttttatacaaaattttcgtgattatataatgatatttatttactttcaccatcagttttatggttggtttttatcttagttcttgcataacaaggttctaaggcacattgttactgggacacggtcccatgtatgtcatgtggggttgtatgtttcttcatgccttccctcaagctttatttgtgatcatattcttcgcattccgaatgtatattcatttctgtttgattatccacactacaactattagatggtaacagttgctatttttcgttttgttagattttggtcgatatgattcgcgtgcctgattgggcatttgaagctgcaggtcaagaaacaaggggcatgggccaagatactgcttcatatcatccaggactttacctaacaccagctcaggtagttttagttgatgtttgcagacttgttgatttcatattagaactcatgcaaagcagtagatattgcttttctttgaaaagtagagtgaactgtattgtcatgtcgattaattagttgcgaaatattttgccttaattctgctattgttcatatggttcttgtgtgttttcagacaatatgtttgctattgttatgtcatatatttatctcgatcaaattccttttgtatatttatattccttttggatgcagagagaagcagtcgaagctttaattcaggaactcccaaagttcaggttgaaggccgttcctactgattgcagtgaatgccccatctgtttagaagagttccgtgttgggaatgaggtatacttttctaaatccaattaaaggtctagagcaagtcatactatgtgctgtttgccatctgatactgaataattctctccattaaccttaagaactctttacgctaagatgtaacgtgtatcttcaagtgatttaaaaatagtcccactgtaatgcaggttcgtgggctgccttgtgcacacaattttcatgttgaatgcattgacgagtggcttaggctgaatgtgaagtgtcctaggtgccgttgctcagtgttcccaaatcttgatcttagtgccctgtccaatctccgtcctgattctgaacggtcttctgacagtgttgtgacaacaactagatacgtgagaggccaaccttctagtcaaagttaccttttaaggttacaggggcttctccgccctgtacgtactgaaattgcagggccagttggtgacacagataatgctttgcaaaatgctgagaacggtgttgcacctgttttgacaacaaaatgcaccaaacagagtccaggtctcgtcggtggaatgcatgcctgtcagtctttcttctgcacaaaggtagattaagtagttttagacctttgactagaagaggttaaagaatgcatatccacatctgggctgtaaaaaaatggttcacattctaacatgaaatttttacattgatccatgaagaaatgggtcagtttctttgtctggggcatcttcgaatggcgtagtaggacttggaaaatcaaggtatacctttttgctttactaacctagatcagaactgcagatctgtagttgattttttttcttttttcttttttccttctagctttttatgttttgatttagtgtaaaaagagttcaaaattctaatcatatggaggatgtgctactttacctgttccattttgttgggcgttactaatacttttactaggagtctaggagaataggcgcagttgactttgaccaatgaacatcacacttcaaataaattttaacaaaaaaaatacatcagttgaagtaaaaatccagacactattttatgtgcaaatatgacgagttacaataaacgtaactgcaattttttgttttttaaaatagtgtctggatctatatttttggcaaattctaccgtacacccaacatatctgagtgtaccgatacatcaaactttaaaatttacagttaaatgagttgtttttttgaagaaaaatattatttttttatcatttatgattataatgattaaatcttattagcaaaaacgtcaacgaaataaaattgaattttttccgcatataatagagaactttgattattttatacgataatatgttaaaattttattatgactcttataaacaatgaataatgtgtttttcttatgaaatgatgttttctaaaatataaatgccgacaaatgactatttatttcataaaattgatcgttaatttatagatttaggaagtaagagtaccggtacaccataatttacaagtgtaccgtagaagttcttattattattttttttttacttaatttcatgcattttcgcttatgcaacaggtgttgattttgcaatcctgtacatgttattgtacgcattttcgcttacatatgtaataaaacaatgatttttcttcttatacatgcaaatcaaattgagtgtagttttttatttttctttctaaatgagcttgcaggtgagagtatatctctaatatgtattcttcaaatttcttataacattgaacatgattgcatacacacatttcctttttatttctaaatgtattcttaaaatttcttataacgtcaaacattatagcttacacaaattttctttatatttccaaattcggacatgattttatcaataagattttttccctaaaaaacattataaattaaataatcgatcaatttcgtttcagagaaaggttgaataatacaccttctaaccctaagttttaaaagaaataaatttggacgtaccaacttagtttttaaacgaccacataatcatcttttaatcgagtttgatgaaaagaatgtaattgtgcaaatattttatgatttaattaaaggacaaaccaattttgttaataaaaaacttaaaaatacaattttgttacaaaaatctaatttaaagaatcttgacatatattgacctagggtagtgctaacaatactctcttttgaacactctctcttacttactctcttattggtttaaatcactttgattctgcatattgaaaatagatccacataaaatggtgggacatacattgattctattcaataaaagagtgaatgctagagagaatgttaaaaattgagtgatgctaacatttctcgtttgacctatttaatagtaaaatagttaggtgtatttaaagctaagaaaataaaatcgtttcagagaaaggttgaataatacaccttctaaccctaagttttaaaagaaataaatttggacgtaccaacttagtttttaaacgaccacataatcatcttttaatcgagtttgatgaaaagaatgtaattgtgcaaatattttatgatttaattaaaggacaaaccaattttgttaataaaaaacttaaaaatacaattttgttacaaaaatctaatttaaagaatcttgacatatattgacctagggtagtgctaacaatactctcttttgaacactctctcttacttactctcttattggtttaaatcactttgattctgcatattgaaaatagatccacataaaatggtggaacatacattgattctattcaataaaagagtgaatgctagagagaatgttaaaaactgagtgctctaacatttctcgtttgacctatttaatagtaaaatagttaggtgtatttaaagctaagaaaatgaaaactcttcgtgaaaactttaaagaatttaaaaaattgataaaaagaatttataataattttaagtgtcatgttaataagtaagtgtttctcggacactctttaagcattataaaatgactggtgctagtcacactccaaaaaaaactagttacccccaaatttatttaaaattttacaataataccaaaattgcccttttcatgtaaaattttaaaaacccatcttttatgatcattctgaacccttaccccctttcatccacaaatcacgcaaccaatatctgaatcaacatctttgttattgatctgtactatattcataaaggttagtgaatttcatgaatttcattttcaatgagtttctatttgtttattgtttgttttggtatgaaatatgttcaatttaggttagtgtaaattaagtttacttgtgttcaatttaggttaatgtaaatttagtttacttatgtcaatgtaaattaagtttacttatgtcaatgtaaattaagtttacttattatgttcaatctaggttaatgtaaatttagtttactttacgttcaatctaggttagtgtaaattcaggtttacatgtatataagaggttagtgtaaactcagtttactcaatctaggttaatgcaaattaagtttacttattcaatctaggttaatgtaaattcagtttacttattcaatttaggttaatgtaaatttagtttacttatgttcaatgtaaattaagtttacttatgttcaatttaggttaatgtaaatttagtttacttatgttcaacttaggggtatattagtcattctggggtgtaacttgtttttttggggtgtgactagcaccagtcttataaaataaacaattattttttaattattttttaaaacagtcaaatattttgattttcaatgcttttatataaatacttatcactagtctttcaagagtgtcctccttaacattttcctaattttaaaagaataaattatataatcagtcccttaactaatatgaggtttcatattgatctcatgattaatttttgtttttatttttggttctttaactcaccctgtcatccaaataaatcctttcttttaactttttttgagggaaatgatttatttgagggacaaaggtgagttaagggatcaaaaatgaaacaaaaaattaattatgggaattgttatgtaattaagcgcatttttaaaaattaaaaaggaacaaaaaattaaattcgaaggagaagcaacgctctacagtttctttcgtcatctcttcttacttatttatttcctctccatcattactcactcagatgtaagtacaactgaagttttctttcattccagatcgtaccatattcgtaatattagcaactagatgatgacggtggcacatggcgtctctttcactgctcccaaactcagatgttttgaggcccactcaaccacaaacccaaacaaacaaagttacaaagtactagcatttactttcattcgaagtacaaaaagaaacaacaccacccttagttgccgttgcacttctcccatgttcaaaatgcagagaccccgcgtctttcttttcaggttggtcccaccctccatattttaatgcatgtcatacatgaccgtgaattctcataatcacagtggctcaacctgattgtgactaatacacacacatgcacacacactctataatccaatttcattatgtgtgtcagcttcatctccaactcgcaattgataaagaagaataccaagaagctgcaaggttgaaaaaggccgttgatgagaagctatctttgatgatgccgttgctcaaatttgtcggacttgaaggtcgcatcacattcatattaacttcgtatataataataagggaatgttagctagtgccccgacactctttaagcaccttaaatggtaatcgttgattttttgaaggaataatcgttaaatttaggatccttaaagagtgtccgggacacttgttaacaagaccctaattataatagtaatatcttagtttctttcctttgcattgttgtataaaatcatagatgacgaacgctactatgatgcttccgtattatcatgtagacaaacgggaaggacaattgctcttctgacattcaatgtgtcttagaaacacaagtaaatgaccaaaaaaccaaacggcagttaattaccactaagggtattttagtattttacttgtgttttaggaagtattgaaagtcaaaaatcaattgtcaacaggaagtggcctcaaaagttttttcttttatccaaaaataactaaattgcttctgttgaaagatacattttgtttccgtttgaattgatttatttgagttgtcgagataactagggatggacatattcggttcactatgaaaactgaaccgaaccgaattaaactacttgttaaatttaaaataactgaacttaatcgaactgtttgcatttcgaactgaacagaactgttccaaaccgaaacgaactgtttcgaaccgaaccgaattgttgttattggtaccgttgaaaaaaataataaaaaaaccaaacgaaatcaaattttagtttagttaccgaactgtttcaaattgaaccgaactgttttgaaccgaatcgaactgtttcagtttcagaattgttagtaatgattctaattttttttttggttttggtttcggttttttggtttttttcgcccacccctagagataactatttgtgagagcttatgacatttttatcagctatttctataaattgtctgtgataacttataaaaacttttgaaaatgatgtatagcttatatgaaaacaggataatttacttgctccgtcaggaactaattagcaaaaatgagtcaaacaaagttgacccatttttactactaatatatgataagtgtttatgatgtaagcgtttaattaagctgcatgtccaaacatagctaaaatgttctaggcttattggtcttacaagtatgctaagacaaacaaaaacacactcatctgtttcctcaaaatttcccaattacctcatccaaacacactctactaaatgtatgggagactccacatcatgatttatgtcaaccaatgaaataaaaagtgataaacaatgtttgttagagagtaagttggcagtgcactcatcttaatcttaatagatgtaattagttggcgtgggcatggccatgtagtagtgctcttgtacttgacctaatgagaatcattattataaaaattaggtgcagcagattaatgttctgtaaaccatcaatctaaattcagtattactactagcgcttaaatattgattatggtactagtagcaccaactttgtttttgaaggacacttgttgatgttagccattttgatcctgggttggctactcaaaagattcagatgaccccttcagtagaattattcatataagtcctggcattgatagatttgttgccaagagttacaccccaaggtatatctttctactttgtcctctggtaatctaatagaggactacagctaatttctgtttgttacagacagttgctcaaagtattacctggtactccagtatttgaaatttatgtggtaaaaaatgctgattatacatatcaaatgcaggtaataatataattttcccactaaacgatgcttgttcattttgacttgctgcttctgtgaattatttttactatcagtactattatttgtgctatgctcatgacatcaaatatgacaggtagtacatttgctacgagccaaaagaaattcaatgagcagccctccatctaaggtggagaatgaatcttcagttgagattcaggagcatgaagagaaggttgaaaaaaatgacgaggtgaaaagttctattgaggaagcaactaaacaaggcattaaaagtgtattatattttcttaaggacaaaattccaggattgcaaattacaacaatgaacataaatgctgaagtggaaggtgcggaagaggatgaatttattattccaccgatgctcaaagatagtaataaaacgacatctagtgagaatattgaagtgaagaggaagttgataatctggatgtacataatgaggggattctagaagcagataatgatgcatcggcagaagaaaaggatttgggtaggaatcattttgtttggtggagtcgtctccagtgagaatgacactcctgttcaggatagatttattcgccttccagctgaaatacaagataccgaaagaaatcattttgttttgcattttcccgggagaaatgtagatggtgatactagaaaaaaaatgaagtctacgaggcagctctcgaagcacaaggaatctcacatcttatgtcttctgaagttgtcaaggcatttttggattctaacaaactctctagaggttagatcgagataaggcatttcagcaccattgaaaaatgcttttgtatttaatctgtttttctgttaaactttagaaaataccttatatgatgattttatttagttttttttctttcttctcagggatgatgattttattagtgatcaattcatgttaactcacaatatttttgaatgaattacactagctagcctctcctctgatttatgatactcatacgaacaccctttcaagtttcgtccatctaacgatttattcccttggaaccttgaaaagttcgcttcttccagctattatgattttgtagacaatgaactcaccaatgcttaacttaatcaaggtttcaacatgtgcatgagtaaccatgagtgtcctccattattatgctgctcctcggagaaattttgttgtcttatttgacctactgaaactaccatagtgagccatagtttccaagtatagtctaatttatttctatgccatgggatgcaacatcaatgattgtgacaccgccaaataaacatttgttacattttgttcgatagtcttacttttgccaacatgcaagtgcttgcaattatatttctcctagcttttcaatcttatcatgaattcaaaattcttcttctgttctttttgtccatacttttttctatcatcttgattcttttttatacccacttcagtgactgttgaagctgtgttgtgttacattctttcctctgcaaagacaataagtaatagtaaaagttatatgcttcttatgctccaagagtaacgaataaagaatatatattgataatgccaacaaaaaaagaatatttatattatattggaggttgattcctatataaacttatctctgcttttggtagtggagagacataaaagggtgtcttaggtaggaagagagagcttcatccttttgaaggttacttcccatagttgatttgtgttattgaatgtcattgtaacgcgtagggggaacctttgaaattgacgttttggttgaagtctgatggaattttagcctttattacactaaagtttgcctacacatgaaagaaatctgattacttttctccattgtaaaagtttttggacccacttggtatatattcccaaaattatttcccatttttaattctttttttatcttcagactctcaaagaaaagtatctcataattagagttgatcgaagataattaaaatataatcattgattgtttcaagctcatatactctcgatagacttcaactgaagtttattaaaatacttgagctcaaccatttagttctcttgtcaatgattcaactaacaaatcgttgcagtgagccagaggacaaaccacatataaagctgtcattattcattccctattattattattaagtattgttaaagatcattttcaaggacttaaaattgggggaatatggaaaaagaaaggctagtttgattttcaacttttttgttggttttatttatctacctgacaaaatttagttaccttatataaaacaaattttcttgcagttcctttatatttttaggataaatactgctactgctatttaattgccatatggttgtttttatactttgttgctaaaaaaaaagtaaaagagaaatgggaaggaaggtactctcaaggaatgccaatatatatgtctagagttgtgtgaaggagctgagtgagattattcttaaacaaaataaactgcccgatctcatttgagtgctacttatggattctgtgagtgatagatataatgcaaacaacttgttgtaaacctacttacaagttatgtgacaaaaaagataataattttttttttacttttattcaattgctaaatcaaacaagttaggacaaaatatttctcttgttatatgtggaaatatctacttgatagagattaatctttcaaattatgaatgacgaatatctttcaatgaatgttcttctacaaatattagtaatttacaaaagacaaacatatattccaacaaatcacatatccacttaattcatcaatttttgcacattcttcccacgaaatagcacaaatcaatataataaccatatgctcaattatatatcaatatgtctttttaagtatctatcaatgcgttacatattagatatgaagtttttttattgagttttttttaatcgaatattatttatgtgcattttcaaaactaaatttaaactcataacctctaattaaacctaaagagatatctatccattattattgagactatttaaaaactattaagactattttttttttaaaaagtacactaattataatgaaacatctttaacaaaaagaaactaatttaattctatttttccagtgtcaagcagagtcaaactttttctcattgcactccaaggatcaaaaagtcatcacacaaaatctgtctgttgttatacgtggcaacatctaattggtcaatccttctcagaaatcacaagaatgagaatcttaaaacagaagaatcaaaaaccgacccacatgtcatcatggtcctacactgaaaaccacgaagacaaaagaccctatactctgtactcttctattctagttcagtttcgttttcacttttccaccattcttctttattcctcttttttcatttcctttaaaattcgccaaatccaaatcataaccacttcttccacaaacgcgcttctctcaataagccaccatgaagaacgcttcgacgaggaactctgattcctcgtctcacttcgactcccctcactctcctctccgatttaaatcctctccactatccgacggcggcgatcctttccactccaccgaaaactcgccggaaaattcccaccgagacaactccagagctatcgtaatcatcgagccttcaatacagcactctcaagtctccgcttccgtaccagactccgagcaccggaaccatccggtaaatgagcaaccggcggtggtggttaacagagccatgaggaatgatcctcctcctaccacaacgaatctaggtcccaacgtcacaagaggaggccgtgaagatggcggcggtaggagtagacagaggacaacgacgccggcggtgccggcatggtcgaaaagtgatgtgatgacagggaaggttgcgttaggattccgaataagcgaagtggtgctatgtctgatttcgttttcggttatggccgccgataagactcaaggttggagtggcgactcctttgatcgttacaaagaatacaggttttttttctttttcttcctatattgaatttcatatattaattttccatattctgttatatattgaatgctgcattatttgataataatcattcaatcgcaatttgaaacaaagaaattagttactaaatttgcatttttttttcactgaaatattgctgttgactatgtgttaaattgactttattgtgattaatttggtgtagtaaaattaattaatggcgtttttattatggggttgtaggtattgtttgtctatgacagtaatcggttttgtatatgcggggtttcaagcatgtgaacttggctatcaacttataacaggaaaacacatagtcaatcaccacctgcgttttcattttgatttccttatggatcaggcaagtcagttttttgtttattgataatataatccaattcagtattcactttcttaactaactgattcttctacattaatgtacttaggcttgttaaataagcaacttaattatgtgtttatgcataagttattttataacatagtataaaatgaaaaatgatacatgaacacccttttattcctgcacctcattgtacaccccatgtattagggatattttggtaagttcatctcacaaccacactttatcttctatttgtgcgggatccaatatgccacgtgtcagaattttgtatgggtataaagggtgtattgccaaatagggtggtacatgtatcatcactcgtataaaataaatcaaattttttctgttcatatgttatgcggaaaatcttatggaaacgctattataaatcaatttttagattcaataaggttgaaaacggcttgtatacatatcataaatcattaaattatttcgtaagttctcacaggtgtctattttagtaaataaactcaaataagtctatccaaaaagatctttccgtgttattttttttaacatgacattttatttttgtagacaggttttggcatatcttttgatatcatcagcatcatcagcagccactagggttgatgattggcaatcaaattgggggaaaagatgaattcacagaaatggctagtgcttctattgcattggcctttcttgctttcatcgcctttgctattagctcacttatctccggttacaacctatgtaatcgttaccctagtaatactttaaccttatactactatttatcgatttatactttttctttcttactaccatggagaaatgtattcaaaataacttcgagtctcgtgaattttaactgtatagacagacttttgtacacttatacttgcatgatattggaggatgaggatgataattttatttttagaatacaattatttatttatttatttatttgaactttatttgtttaaatattgtcttacacatcacatgttctgttccaccataagatgaacttgatcttgattttgaattttttcttcctttgataactaatttcttgaaggaaaccaatcatagtcatttacaattttcattatagaatttatgagatacatccaaaagtttttaaaactttaaaacagataaaacgaccaagacacaaacagaaaaggatcatggaagattgacagaacttctacctttaggtgttgttcttaacatctctcctcttttgagtaataaatcacttaaacatacaggtcattgaaaccggacatgtttctagttattgtttgataaatcatatgttagattattttcttacaagataatttttaacatccaaaatgaaatttgaatattttgccaaattctaggaactcagctcaatactctttcattattattcttcttctgaagtattgaaactcaatatcgaggttctgaatagtagatattattgaaaaatgattcaacacgactcaaaagctttttcaaaagagcctaaatgattgttgttaatagtgtcaaaagcttcttcgtttgaatcaatttttcaaaatgccgaagttgtagcaatgcttgttaactttccaaagcatggtcatatgcttcggttcgataagactcaaccactttatggctttttagtgaaaaagtataaaaaacaagtaaaatctaaaaattaaccaggaaaatcacataacctccattctggccaaatttttagaaaatgctaaaatcaacaattagtcgtcaaagacatacaaaaccacgatgtaaacaataattgataaataagttatccaaaaaaataagataaatgagtttttcatatatgttgtcgatgagtttgatcacacctcccctgctaaccgagtcacatgaagaaactgctaagttaggttggcacttctccagctgatcttcatttgatgatttgtcatcctaaatgccaaaaacattatcaattatcactctgaaatcattcaaatcaaaagtttacaaagaggtataaaaaacgaagcaaacaaatattaacataacatgaaatattaaaaaattgacaagatgcattccacaatcaataattttgtgataaaagtagttcgttctcatgagcacatgataagtatttgatgttaaagagcataaatcatatggcatgagctgcattgtaagaatgaaacaaacacaaataaattgaagggaaactcgtatagttcctttgggataaagaatgggttctgtagaaacaaaaccaaataaatgtgactgtgttcatttctttaagcagcgtgcatcactgcttagggttcacacgggaataacatatctgagacttttttcatggggtttattcttcaattgattgaaagaagtctcaaatgttatagttttagttatagttatagtagaaatttgatataaataaaaaataaatcaaatgaaaaagatttgaaaagcttacaacaatgctagaatattcggtggaggaagattgtcatcataaatagaaaatgtatggtttttttttttaaatatttttaacagggtaataatagtgttaagtagtaagggatgtgtttatctattattactagatataaagttgtattgtcatcttacactaattttgttgtaagttaggttagagtagtaaataaagttgttatagcgagaacttccttatcccatcttagaccctcttattttttatgatgtaccctcttatttgtacatattaattaataatgagataatctaatttagcctttgaaaaaaagagactttaggggagattaatgtcagctataaaattaattagggtgtccgtgtcaaggtcatacactcataccatttagatttatataagtgtagattataattgctgtcaaatgttgactaaaaaaagtattttcactatttctagcatattttaaaattataatactaaccaattatttggttctaatacaagctcaaagtaaaaacatataaaaaaatggttgaaaaaattagtaaatctcaataatatataagcattaacttaataatagttgttgtagtgtcatccaccaccgatatcatgcataagcatttatcgatttcagtctaataaaatgttttccaaatacactcgagacaataggcatatttcaatagtaccactcaaccaggagactcaaaattaactacaatgaaagggcctaaactatccttttattttgaaattggattacaaagacgtgaacgtaaaacaaaatgcaaccacctaaatccatgaacaactataaagaataatgtatgttagattggataaattgttcaacgagatattgaaaaaaaaaattgttttagataattacaataacaatggtattttttttttttttaaattgaatacctgtttaagtttaaaaatctgttatgtcaactttcgtagacggcgagttttgaagtaagaagtcaactattccatcttgtatgggagttggttttaaacccgtttcaaatgctactagggagacaactcgtgcgttgcacgggtttgactaaattttttaacataaatgaaaagaaaatgttggtcattttttatttttaaaataagattatttttgcaaagtaatttttttttattttttggagttgggtttgatgaagcaaaagcgcatttgcatgctattagatgtaaatttgccttgattttaagtagttaagaattaaagattatgttaaagttgttttatgtcatgatttcaagcaaaacgtgatttacagaccgcctatctaaagagacactaaccatatttaaagattaaagtgtccgagtggatagaaatgaaaagaatgaaagtgtacttgacaataaaaaaattaaataaagatttaaggtaaaaacttggattttaccttgtaggcctgtattttaaaggtaaaaattcaaaattaccaatagcatatgttccatcctaaaaagttagcatatattccatcaaaattaaatagtgatttttttaaaataaaaaatacgaacacatgaaaaggcagtttttcacattaaaaaaacataaaaggaattagaaaaaaaaaaaaaaacaaactacaaatacctaaaaacgttaaattttttaaaatcataaaatccttctacccaatctgaactctgcatgttatgattgacagtttcaaaggctaaatcaatccttgatccgtattcaccatcataaacgatgtcggcggtgttattgtcgtagattgctctctgttgatatcgagtgaacgaaccatgtttccactacagaactgttgagcactgagaagaaggtgatctcaccatgtaatcgttggtaagagcgagaaatccattcctttttttttttttatgaatcatttccctcttcttctcttctgttcttcatttgtgggttattttttgttgagctctcacttgaatccattactgagttcggcaacaattgtcctcccactattgttgtacacatgttgttccttatagctcaatgaagctagacatataacccgtgcgttgtagagatttcaatagagttatgtaacttttttagatgttaaacattatgtcagtgttttttaagtaaaaattttaattagtttacaatgaagttagctaaatgttaataaggaaaaaagtgtcatttatattggtcttgatatgagagcaataagcacaaagaggcttgaatattatttattttttagtacaaaggatggccatatgcccaatttttttttttttttaattctttcttatttaactaattttgtaaaggataaaacatattaagaagtgttacttgaaattactttcgttattatagttattagatagaagaagaaagagtgagaagttataagatatgtaagaatattttttatatgtgagaatgttttttgaaaaaggaattacacttgatgaacattaaaacccacttccaaattcatccaagagttgcattaggtaatagagtttttgttggctactctattagatagaataatagtcgtgaaacttgtttagatcttacacattatgacaatattttttgaagaacagccgaatttagtttacaaagaatttagctaaatactaataaaaaaatgtgcaatatatattggtcttgatatgagaatgataagctaaaaaacctttgatattagtttttttaatctttttttaatctattcatttactcttattaaattaatttaatgaacggtaaataataacaacaaatttattaagaagggatgataagttttgtaacttaaaattgcttgcattctcataattattagatgggtcttgctaaccggtgccctcgggcactggttaagcataccatacaagggaattattaccataaaaggaaactgtttttgacattattataaattaattacacaatttcaatgcattaactactatataatttcctttttcatacccttaaccagtgccccggaggcaccggttagcatttcccttattggatagatatattagatagaataagaaagggtgagaagttatactatatttaagaatatatttttagaggtggcacatatgcataattaaaacttcataataatgactcaattttagtttatggaaggtcttagaggtaccacatcagcatcatcacaatatttcacccaaatttactcttaattttaagaaactcaattgatggaaagtatgaatgtcaatcaattccatggtcaagggttaaatttccatgttgccgcgttcaaatcatcaaaacgtgactttgtctctctaatttcagaaagatcaagagcgttccattagagttttgagtagatatctccttctacaattagttaccgaggcattgatgctttttttttttttgaaagaaggcattgatgctaataacttttataagaaactattcaattaaaaacataacacacgggcttggaatgaaaatgaataaaaaaatattacttttttaatgcatttgtaatatgttcccttccacttctttattagactcttgatcttataacaatgttaaattaaaaataaattattttttttttaatttcaataaaaacaaccaccttttcatatttgaagtgcactctcaacaaaaccctccattttctcaaaacttatgtatgtgaaatcagagaaaggaaattcattagagaaaacaaaaaattatagaaatatatgttgaaattgggggcctaactcatccttacaaaaccggcttgtaaggtgaggattgcctcctctttataaactcttctcaagagtcttatctatccgatgtgggacttgggtttttcccaataatatacatatacgaagcttgaacagaaaatcagaactatcaaaaaatgaaatggaagaagaaaatgaggagctttgtagtaaacttgtgtgtgtaagaggatataataaaaatatttttttttgtaaggataataataaaaatatattataatgcattcattgtacaacttgcatgaagtgaagtaaatgcagtgcttttgcaaaaagaaaataaatatagacgtgagcaattatcattacatttcttacaatgtttcattaactaatcaaaagtaactttttagtttttatttttttattttttctttcttcagaaatataaactatttggtcaacctaaaagtaacttgagtctctattaagtcataaaaccaatgaatagccaagagatgataagtaaaaaatagaaaagaaatataataccaaattgaaaggtaccatccaatattttcttagaaaaattaatgatgaacaaccattttttataaacttcttcatgagtaacaacagtgcaacaaaaaaatagaataattatctatcctatttttctaatgcacataaaaattttccgcatacatatcaaggaataaaagaaaatataaaagaaagtcggaaaatagactaacaaacatcatataaaaaaaatagaacttaaatatttgaccaatctaaaagtaatttgactccctatcaagccaaagaaacaattaataatcaagagatgaagagttaaaatgagtggaaaaaacagtaatacaatattgaagatgaactaaccaattgttgcttgaatgtggtgaagaacaaaacccaaaatttggtgcacaaaatacacatatttatacacacaatgtttctcaatgacatgaaagtaaaaaacatgatataagattagaacatttagatagcatggtagaggaaaagtgtagaaagatggtttggtgttattgacatcaatagtagacatggtggaaaagtcaagaaaaaaatgaggcaaatgataaaattgatcatcaaatattacagaatgagcagaaaaggaatgagatttgcgttggttatcatgtaggtgaaagggaaaaagggaaatatggatgatctaaaatgtaacatctttttttaaccttttatatggaagaatgtaaacagacaaattcaatggtgatggtgtaaatattatataacaaataatcaatgttttttaaaaaatagtagttgaaggagttataagaatgaaggatgtaaaagttgtgtccgatagttttgtttgtgcggcgacttgtttttttttttataattaaaataataatgttcagttacacttggttaacattgatgtgtatattcctattcaattagttctttcttattaaggttgcaattgattagtgtaactctttttatcaaaattattatgtataatggtttgagggagtgacacataagcagagtagaagaatgatcaagaataaaaattagaaaggggatcattggtgaagtgacatgtaagcaaaatgtagattagaatacatgtatatagagatagagattcgcaactcatcagcttcttttcgagacttggccacagctttgactaacatgccttctttcacaatggagaatatttcctgtagaacttgaagtggttccaattttatttccatagactttaagttacacaaagaagggagcttaacttctaataaaccaggaatcatgtagagaatctagcaatgagaaattataggaaattaggatcaactatgcaagtcaagtaataaagtgcagtaccaaattatttatcaagtaataaagtgataagtaaggtatcctatccacatagattgttgtttcgtcttgaaaacttgatcaaactcaatgttattctgttaaaggagtttacaatgtgtttgacgcatgatgattagcaagttcaatcgcctttcacgaagatcatttggaacaaagtatcactttttcgtatgaagactgctcaaaaataggctcccaacaaaagataacttagttagacgttgatttcttcatccatgatctctgttatgtttgggttgttgtggtatggaggaatcaaagaatcatttattttgtactatatataacttttcagagatgtttgatcattcatttcaaagtggttagggatttctagtgcgcctccatctgaaattgtcatgcatgctacacagtttggtgacaactattttttcgaaaggacatttgcatctgtcttcaaattatttggttggaacttggattatttgaaaggaacacaacattaagatctttcaaaacaaagaatcggctatcactaaattgttaacggggtgaaatttcattacatagtggtggcttaaggtttatatgactcatattttctctctcgattttcatatttggtgaacaaatctatcagcttgtttagattaccccccgtaatacagtgatttggttgcagctgttttttattttgcatattgtattttaatactttgtactctggttagacacaacttatgcttaacttattctccttttctcccgtatttattttaatcatcttttgacttcttaaattttaaatctaagacagagagtattagtgtaatttttcgttcctcgttatatacacatattatttcaccaaaattaaaagatctgatcgttagcaaattttttctttctttaatgtataaattttgtcataaatccaacctcaatgatgtggttggccaagtagcaatttccttcttagattatggagaagctgggacaaattatcaacgacatcaataacttgtttgtccatcacgtatatattataacattttttttgagagaacgtatatattataacatgaaaggttaacatgtgtctttaaaatattcgttaaaaagtttaaaacaaaaattttatttttgaaattatgaattcaatatattaaaacattaaaagtcaaattttttccacatacttaaccattatttcatttttttttaaatctttaacaagtgtgttacttcttaacatgagctattagaataacccaaaatagactcgtgttatgtaaagagttattgccgacaacacgtctgcacttgtgattattgcctgatcaatttgcccattatgatgggatcatgcgagaaacaaaataatgtaagaaataaaacatcgtcctaatccttatgtaggttttttctacattaccctctcttgtttagagggtaatttacccctttaagatatcaatcaatcaaaatgtaatatataaatgtaacattaaatgtcaaataaatgagtcaatttttctataaaaaaaatcaattttaataaggcaacttttaatttttatttaattatatttagatatacaatcttaattaatttacactagctatatgacttctaacaattaaaatttcacatcatattcaacccatcatggatgtgtttggtaacacgaataagctagtttataaccttgtattgatataataagatgtgtttggcaaaaagcttttttcactagcttatagcgttttttgagaagctatttcaagccgcttttgaacttatagctggtagttttttatattttcttccaattttaaccctattaatttaattcaattattttttaataaaacaacacgttcatggcttaaaaattaacggccaagttcatagcttattttttaataaaataactgccacgtttctcctttgaaaaaaatctgacagctttattttattttttaatgaacgctttataaatatttcttaaaagaaatgctttatatttaattataactagcctacggtacgttgtaaaattttatatatgcttgcttatattattttccaccttcctcatattttcgggattcataaaagtagagatcaatgaacttttgccatcttttgtacaaaaaaaataaaaataaaaagcagagatcaaaattgtcggtgaaattttattggagactaaaaccaaaagtttgaatatttacggggatccaaaacatagttaaccataaattaaaatattaaaaaaataaatacattagaaaaaaataatctctgtctctctctctctctctctatatatatatatatatatagaaacatgtccttttatgtcattttatacttatcagccacttcaacaactaattttaccaaacacttcaattttaataaaccatcttttcagctataagctatcagttataagacatcagctataagctagtttttcagctttcggctagcttataacataatttaccaaacacacccacatacgttcataaattttgttctattccaaaacctagaacacacataacgtgcaatttcttcttcattcttcttcccatcttgattgttcaattctctcgttccagaattgccgtcgttccagttatcgtgagaatcgttgtcgtccttttgattccagacattgtgagaatcggtgttgtttccataatcacatcaggtatcatgacttgatttttcttcttgatttgatttttcattttcgtttctttctcactactatcgtgacttgattgcaactatttcacacttataatgcaacaatggtaactctcaactttggcatgaattccaatgatgcttccatttttatttgggttttgagtttgattgagttgtttgagattatataaaattgtattttatcacacatattttgcgtttgattaagataaatgaatcttcaatgcgttgattattaattttatttttggtacaatattgattattaaatttacttttggaatttgttttattcaaatcattatattgtgttgttatgttgtttttgttcctagtgaattttgtgttgccgaaatgaacatttgttgagattgtgaacatggtgtgaggtcggttaaaactatgaaagagaagacaaagtgaaataaataataaataatgctaatagaaacatgaatttcataaggtgggcattaattcgtgagcaattcgtggatataacttttggaaacaacgacagtctcacgatgtttggaatcaaacagacggcaactattctcacgataattgaaaatagcggcaattctggaacgagagaattgaacaatcaagatgggaagaagaatgaacaagaaattgcacgttatgtgtgttttaggttttggaatggaacaaaatttatgaacgtatatgatgggttgaatttgatgtgaaattttaattttacaagccctatagtgtaaattaattaagattgtatacctacatataattaagggttaaatatgtttttggtccctataaaattgagaacttctaagtttagtccttacttaactttaattatcctttaactcttaaatttttgaacgatttttttgagacaagcttagaacactatgaaaggttcatttactaaaatttagaatttttttaacatgaaacgaattaaatatgaaaattttaaaacgaaaatagttcaagaaaaaattaaacaaaatctgaacgtataaataaaattttgcgacaatttttttgcagaggaacttttagtaatgttcttaacatgtctacaaaaaattgttcaaaaactcaagagtttaagcataaattaaacaaatttgaattgaggatggactgatactgaaataaatactcatgtatacagaaaaaaaattagggactaaaaaaattattaaaattaattaaagattaaacttaaaagttaccttattaaaattgattttttttgatagaaaaattgactcatttatttaacatttaatgttacatttatatagtacattttgattgattgatatagggtaatctaggcctcacccccttatgtatgattaagcaaaggttattacaacttgttactaaatatcaccaagagcactagggctagcttccattggtttactcaatgatttcgtattgcattccttataaactagtatgttgataatattagtaatttcttaaaaaaaatgcagtactaattaataatacaagagaaaaggaaaaaagaaaactaagtaaaaatggttgatgtatagtacatcattatccatatataagccaacccacgagatataggaattcatggaactaatttagacgtgtgaagtgctaacgttgttggctatgaaggaagcattgtctatatccagaggtagccttcaccagccatgcacacatgggggcactggcctatatatttcacgtgattctttgcaggacatttcctctctatttcgtaagtcatagtacattgaaaagatcgctatggggtactaaaaaaagaacaagaatattctcttgctttataagttgaatttgtaaaaacacattagatacatttttttttgttaaatattctaatagtaagaatttcaactcttaagtgattaaattttaaatgttatattccaacttcaactcctacctataaaggcatgttaaacataatgtactacgtgcttaatttttttttttttttatacataagccttgcaaaatgcaatagtcttctttagcaacaaaatggcagtaattaagtaagtattatatatattttgataaaaagttactttactattaaaatacatgtagccgaatttttttataaaaaaatagaaatagaagcacaaatttaatgaagctgtacgttattctacaaaaaaaaaaaaatgaagttttttttttttttttgaaaggaaaaatgaaaaaaaaatgaagttgtaagttagcatatgggaaaaggaaagtgattgataatgacccaaaatcgatccacatcttgagagaaaaagaaataaacatgaatgatgtgataaaaaaatagagataaagataaaatagagtgttgcaaaataaaatttgattgttgttattgttacaaattcaaggatatctaaatataagtgttcgaaaaacatatgctaatgaaaataacgatttaaaataaaaattattcaaaagaacttaaattcgattcatgaataaaaaattcttaacctaactgtacttattttccaaccaaattctaagttaacataaatacggagagttagcaaaaacaatcttaatgaattaaaaggttgtgaatgtgatggaatgaagagagtaaaataaaaggaagaggattgagtgagtgagagggaccagaccgtatacggaagaggaccgttttttggttactttatacggcttgtccaaatccaacacagctaagcctaagcctaaaatatatatacatggtccaaaatcaatgggacgaaactacccctacctggtggaaactaataattagtgtttgtgtcgaattagataacaataattggcttgccagatcttgaagcataaatattgaggttcaagtcccctgttaagggcacacctgatgatggtcaaagtgaagacagctcagacaagttttatggttctcagcttttctctccttaattacgatttttggatgctttgagtttcatccaacacaccccccctcggccctcctcattactcgtacataacagtacagtggaaaataaaaccaaaaataatgccaataatccacttcaatcagtacaatgcaatcaccacaaaaagataaaagaattaaatgctactgcatgcagaaaaaacctaaaagtttatatattttttcaagtttattttcaaatttgtcaggagttagttaccagctagaagttagttggataagattgagataaatagttaaagattaacttaatcatagcgtttacttgacagtcaagtaaccataattagttagcataaccatttctataaatattggttattgcatttgtagatatatagattgacatagagaacacttgtacacatctttctccattcaataatatttacgttcataattcacttgagtttttaccacaaattagaagtgtatcccaacaatttataattattttctctcctttaaaaaagtaaattatttcctctaaaaaattataattaaggagagaaaattagtttatgttgggttttggtctaatccgctcaaatttgtatcttcttttatcttttcgtattattggataaattttataagatattgcaaatgaaaggtgataggcttggggatcagcatagactcgttgtcttgctctgtcacatgtttcttagcactttatttgttttgtttagaagaaaaagtgaattcaacatccttaccatagatgttgttctccttttatatcaatcccttgttagggttttatgtggttcctgagcctcccaataattgattgatccaaaactaaatatgttatgagttcaggcgaacattttatttattcatgaatcatgacacttcggcaccctgatcatctgtcaccaccgtgctcgccttcaatgattcaaggttccctggttgggcgccctgagatctcttaacctagtcttaaattcctctggtcggccgtcctggattccatcacttggtctttgagttaccaacttcaaagtaccgaacaaagtccacaaaggtcgaagacgttctaagaagatgctctaagaagtcatagagaccgggctcaaggtagcatacatatatattgctagtttgtaaaaacgtgcagttgtagaggttattttagtaaagaaatagagctgaaaaattgaaaatgatcaattataaatagatagaaaaaattatcatgtattttaaaacagagataatataagttattacatgctgatattatttatttaagtctaataaaaaaaatttaacatcatatttagtctctaagatctatctattgagtaaaaaagagttgttctactttaccaatttctagtccttctcttataaaaaattcgtgctttttttagtaaaaaaaactaaagttgttcaaataaactgtgtttgattttcggacaaaacaaaaaaggtggtcaagttatacttacctcaccgaattttgagattcatggccactttcctcatagaatcgaagggttagcatcaaaagaaaaatttcaacattgttatctttttcattaaaaaactcatcaaatttgtaaacatatcttcatcgtataaatctagaagtctagattttattaaaaaatctcataaatccatttttctacatcaccttactgagccataaccaaaaccaaaaacagccataataaaattccaactcggtacccaaacaaaaagaaatagaagaaaaattcaaggagaaatgggaaaaattacatgtctttttaatgagtttttgatgatttttttgggtttttgataaaatttatggatattttttataagataacatttataatataaatgattaaatcaaaagaacaaaaaaaaaaaacaaaagtgttatataaaattaagttacatgaattacttaattttgcatcaaattttattaagggaattttggctcaaattagttataaaaaaacatgaaaattcgtaattttttttttagacatcataaagaataatttgaattaagaaagtaagaaaataagaaagagtaagataggggtcatgatcaagtagacccggtttgtctcctgagaagtatatctacgcacgttgggaacgtagagatggtactgtcagtgttattacaaggtggtggcaagagccagctcttcgcagttttgccctttcactgcttaacaataattaattaagacctttctcaatttcattacttatgttatgtgctttcctaatgaaaacaactacacctataatataatataatataatataatactatattcttgtttacactcttatcttattacacacacaataagagaatgaaatggtttccatttgcagttggtttcttcttttctaactggttatataccatgcaaatgatgcatttttgtttaaaaaattagtctagttttggaaatttggtttaaaatcttataagagttaaatttgaagcatgaagaagaatttgcattggttaaaagaaatttctaacaatgtgaggtctgggagaagactttcactaggtgaatacaagagagctgtgtcatggtcaaagtatctaacttcctctggagcagccataaagggaaatgaacaagatgattggaatgctgatatgtctcagttattcattggtgccaaatttgattctgggagacatagcaggatctacagaggtatctataagaacatggatgttgctattaagcttgttagtcaaccagaagaggatgaggaattggctgctttgcttgagaaacactttacttctgaggttgctttgctgtttcgtttgcgccatccaaatatcatttcagtaagttctgtttcttcaatcatttctatttatatatagtatataccaaccataattagaaattgcagctgtagttatgatcgtagttgcgaaccttaatattgcaacaaaatacaggcatatgcagccgtaatttcagttgcaatgacgtttcagagacctctgaaacctttatagtgtgagaccgcagtttagaactatgagactgactttgatgattctcatggtttacatccttttatcatatactgtctgttttgagtatgttccttttaactgtttttgcttttagttccactattttgaatagtttctttggtcccaaggttcctttttttatttaggcagtttctttttccaccatgcgtcatacggattttggattttataatccaaaacaacgttaaacaccctccaaaacacgtttaaacacccctccatgttttcagattttataatcccaatagggcacgctagaagaaagaagggtgggaaaataatttgtcttttatttatttttacatctagcctttagcccttgcatgtagtgtttattttaattttaagtgacaatatattaattaaatagatatatctatggcttcgatcccaagatgcttttttgatccgttactgcttaggtaaccatgtgctttgctaccactccttgattcatctttgatttagggcctgtttggaatttggattgacttttttgagaatatttattggcagaagcacgtaagactgtttaggagagtttacggaagcagctcatgacatgtccataagttgttttcatcttattttcacaagttcttcagaataacttatgaaaatagtttatagcttacataaaattagtttgacactatcttctttttcttgttgtaaaatagtttatacataagcacttgtatgataaacacttatgttataagtgcttaattaatctgtttatccaaaaaggcccttatgctatccatctcatatatagcagacaatcgtgatttttttttagttgttgaattcattctcttccgaagctgatgaagtactatgcagttaatgttgagtatgtttccacattttattaacacattttgaatctttgattgatcattgtagtttgttggagcttgtaagaaacctccagtgttctgtataatcactgaatacatggctggaggctcattgagaaaataccttctacagcaaggaccacattcagttcctctcaaactggttcttgaattagcccttgacattgcaagaggaatgcagtatcttcattctcaaggaatacttcatagggatctcaaatcagaaaatctgctattggatgaagaaatgtgtgtaaaagtggcagattttgggatctcatgcttagaatctcaatgcggcagcgcgaaaggattcactggaacttaccgttggatggcgcccgaaatgatcagagaaaaacgtcatacaaagaaagtagatgtctatagttttgccatagttctttgggagctaataacaggactcacaccatttgataacatgacaccagaacaagcagcatatgcagttactcacaaggtattgctattgcatacctcctgatttactttagagctatattattttgacacacaaatttgataacaaatttcatctatggaacataattaatcatctaatgtacatttgtacacaatattttgtgcatttctataaactcaattttttgaaaatttgtgcagaatgcaagacctccattaccacctgactgtccactggcaattagtaatctgatcaagaggtgttggtcaagcaatccaaataaacggccacattttactgagatagtcaaaattttggagaaatataccgactcactcgagcaggatccagaatttttctctacctacaaaccaagttcaagtaatatgcttgtgaaatgcttaccaacatgtaatgctggtaatgagttcacttatagcaaagcctaggatgatgataattgtattataccaattccaggaaggactaatatggtgctatttgtattaacttctagcttacagagtctttaattagaagaaaattatagttcttcccttgcaaaaaattcgctataaagagcaatttttgaagttcttataagtggttatggaaaaataaatgatagtttttttaaagaattgaaatacaagtacatttaaatttatgcaaccggttattgtttaaaataattcattgttaaatatatttttttatgtttttctaatacatgatatttgagaaatttattcaaattcaccttattactgaataattccatttctttgtttctctctatcttattttatttttaaaaaacttactttgcatttatcagttcatcaattattactgaatagttatcttgttttaagaattatggtttcaaaaatcaattattttcaccttttttataaaaaaaattacaaagagggcctaagatgtaataaactttagctcatcaaactattttttttactcaatgacacctatacaattaagtcttgagagttgtaagatcaacatgaaataagatcttgaaggttgaagattgcggtaagaagaaaaagaacgtggaagtttatggtgaatgagactgagactcaaactaaatacgaattttttatcgaagaaactaccaatcaattttaaaaaaagggggaaaaacttaatcttgattattttttttttttaacattaatcttgaaagttcattgtgtagtttttttttttttctttttttttttccttaggtttgttgatgaagggagatgatgaaggtgataaatttttttaggtttgaagatgaatgtgatgaattttaacatttgacaaaagttaacaacaaaaatttatttaattaatagagtatatattaagagatcaaaatgtaatgttaataagttatgagactaaaataaaaacaacaaataagctaagtaataaagttggctaagttgaaatgttaaatattttagcaaaacaatagtgttaaatctttaatatataacaaattaaagtttatatactaatagaaggagccaattacacaacaagacggtttggccgagtggtctaaggcgccagatttaggctctggtccgaaagggcgtgggttcaaatcccacagccgtcattcttttttaacttaaaaccatttttctgttttatatatatattgccaattaccaacgttgaggcgagtgcttgcttggcattttccagtgcttggttaaacttgtgttttgataaatcaaaatattttttcattaaaaacactaattttagagctttttataattaactatcatcaaatcggacattgagaggggaagagttttttgggttttattttttttaataaaacaataatactcttctcgtttggaaaatccaaaaactgtatttgaagagaattatagaatgtttatatgaattctttaaatttaatatttattgttataatatttttaaaattaaaaatatgttattcataagtattaatttatttatttatttttttttttggtacaagagagggccgaagcccaaagtattaatttattactctctacaaaattgctctttcaaaaaatatgaagtattttttcatttttctttatatttcacaccatccaaaatccttccgttcaaactccaaaacctaagagcgtgtttatttcaaagattctagtgttatatatgagatttggaatccaacttgttttaagttttaaaaaattatgtatatataacttttattcctagaaatgttttttacacgtgattttcaaatttctatttctatgctcaaagaaggaatttaacatttccaccggaacaaagctcaactaaccataacttttcactaccagtcacatttattggtatttttattttttaaatcaaataccattttaaaaacattctaaggaaataaaaaaaattaccaaatatatgagttggaatattatttatggaaattttattcttataaatatcattttggggaatataatttcaaaccttaaaacaaacaaccgtaactgtaacgtcgacgttgatgaggacgaagtcggagagtgatactgatcgtcggtgcacaagacatggcaaatgagcggctccttttaggcaaaccgaatccactttgaaatgagagggttcctgaagccgtgcaggtatgagactatttggtcgaaggaaagcttacaagaattgtttggtactacatataccaacaagatgcatcttctttttggtagttatttcataagaaatccacaattaaacgtgcttgactttgagcaattttgggataggcaaccttctgaaaagtatctcgaacgtgttacatgcagagattcaagtcctcttaattggcattgagttgtgttggcaagcgggttttaaaaaacttatttgttattctgaatcccttcatatggtcaagttggtagaacatatcgatatcacaataatgttaatatggtggagactatcaaagattacataaaaaatgattggattttgttttgaaaaatactcttcgtgaaaggaatgcttgtgtggatattcttgcatagttgggagctaactatgtggactctttgatttattgttaatgaattttcctagtttgtcttggacgcttctagcggacagtgtccttttttaagacttagttttagttctttttttttttcttctctctcatgtaaccaaaaaagaagggtttatatttatttaataaataaattgaaatatgggaatgccatgtggcattgggagttagaggaagggggaaaatgacaaagcagaggatcacagaccgttgcaggttgcgcgcagttagttggtttgtgaagaagttccattccaactctgcaaaaccaaaaatccttttatttttatataacttttctttaatatgtttgatttcaatccttcttcttgttttacatttccttctggtttttatctccgcttcatatttctctcttggtttggtgctcattgttgttaaggtatttcttctcatatatttattttctttcaatccattgtcttctattcatgcatccaatcccaatatcagaaaatggcaatttggaacatatatttaatgattttcttatctttcgtctatttatttttgttaaatcattggttatgcatgtgttttttaattaatcatgaacaacttgttcatattgttcattgtcaaaaaaagttattgtaacatgcaattctaacttaattcaatgatttaaacccttgcatgcatttgtcttataacatgtgtttttttattattcctaaatgattttggggggttttgttttgtagattcttaaccatgatttatttttgtaggttctttgattcctaggaaatcaaagatgccaagtgttgttccaattgaaggaaataaaatgaatgaacttgagaacccttcaccctctaagaacatctataataaaatcaattcaccaagaataccatcgagcccacaaacacctagaagtgttgagaggtttcatgaaattgtacatgatgcaagacgttcgcgtcgaacacgctcaagtcaaagctttggatctgatagtgattggtctttaactgattcagaatttagccatattagtggagaacaaatgaggaagttggagatagtgaaagaggaaatggtgaaaaaggtagtcagggactctagcagtgaaacaccatcaatatcaagagctaagggaaaaaatcctcctgcaaaacctcctgttgaaaggaagaatggaaacaatcctttgagaaaacaaagtacaacagttactaatcgtgcggtaaaacctaagattgcttctattggaagatcaaggtcacaaagtcgagtcgacgattctaaggaatcaacatttgataatcctgagcttggaccatttttactaaagaaagcaagggatttgatttcgttaggagagaacccgaggaaagctctcgagttatcacttcaagcgacgaaattgtttgagaaatctgcgaatgggaaaccgagtttggatctggttatgtgtttacatgttactgcagcaatatattgcagtttgggtcattataatgaggcaattccaattttagagcgatcaatcgaaattcctgccgttgaggaaggcaagcaacatgctattgcgaaattcgccagtcacatgcaacttggagacacttatgctatgctaggccaacttgagaattcaattatgtgttacaacaatgggttggaagtacaaagaaaggttttgggagtaactgatccaagagttggtgaaacttgtagatacatagcagaagctaattttcaagcattgcaatttgatgaggctgagaggctgtgtcaaattgctcttgatattcatagagaaaatggttcaccctcttctcttgaagaggtggcggatagaagattgataggtcttatatgtgaaactaatggaaatcatgaagcagcattggagcaccttgttttagcaagcatggcaatggtatcaaatggccaagaagtggaagtggcgtctgttgattgcagcattggagacacattcctatcattggctcgatacgatgaggccatcttggcatataaaaaggcgttagcggttttcaagactcacaaaggagggaatcatccttcggttggatcggtcttagtacgtttggctgagttgtataataggacatggaaggtaagggaatcaaaatcatattgtgaaaatgcacttaaaatctatgaaaatcccatgcctggtgtcccttctgaggagattgctagtggttttgtgaatgttgcagctatttatgagtcaatgaatgagcttgaacaagcactcgagttactgcacaaggcattagagatacataatgatgcccctggccaacagaacacaattgcaggaattgaagctcaaatgggggtcatatactatgtgttgggaaaccagactgaatcttacaatgctttcaagaatgccgtctcaaagcttcgcgccacaggagagaaaaaatcggctttctttggttttgttcttaatcaaatgggtctttgttgtgtgcaacttaacgccttgagtgaggctgtcaaattattcgaagaagcgaagattgttttggaacaagagtatggtccttgtcaccctgaaactcttggcgtatatagcaatcttgctggcacatatgatgcaattggcaggtatacattttatagtttgtgactgtcttcatgatattgaggcattatccaaagcaagctgtagctatttgtgatgttgtatatatatttgactagatctaataatcaagtaggaccactaatgttgaaaattagtataatgtctattatttgaataaaccaacccacgctatatggtatggtatgtagtttcttgcttcatggtttttgagacttttaggttagatatgaccaaataaagaaatgattatgtgaaagttattttgttcatgtactatgatattctatttcagggtggacgatgcaattgatattatagagtacattgtagttgtgagggaggaaaaacttgggacagcacactttgatgttgttgatgagaagagaaggttggatgagttgttgaaggaaacaggcagagttcggaagagaaaaaccaagtcacttgagattcttcttgatgttaatgaggactaatgatgaaacactgtgaatgtgctttaatgtagttctagaaaagctaggtaataagcataattgattaagaactggtcattgtggtagttttatggggctgaaattcaatgattcgagcttaatgatttatttgtactaaattatgctaccttatttgtagatacaatgtaattaatcggattcttcttttttcagattaattataataagattttgatatgttttgatctagtttttttttttttttttaaattatttaacaagattgatttgctaacttatagaatcatatgatctccatctatttttgtaagcaactcttccgtgaatgtaaaatgatatgtatgaaaaatggttagtgaagcatcatagcaagatatctaatcttcaacattcacgtaaaaataaaaaataaaaaaaataaaaaaacattcacgtcttattaaattaaattatgacacggcatgatacttaaaaaggaaaagacacaacaactaataatatttaatttaacaactgtcatccacaaataataatcaatatataagatgtgctcggaaaatttagctcagttggtaggtacaatgcatagtatatgtaagattcgtggttcaaaccccgatcaccacaaaaaaaaattgattgaatgatttttttttcttattcgaagaagtttagctataaaatttacacacttaatattaagttctattcgaagaagtttaacggcaaaattcacacacttaatattaatattaagaattgaattgcgagtttgaatctacatctcatcatatctaatgtattggagttgagttgtacttataagatctaaaattttattagtatgttatgatattcaatcaaatattaacaaacatcaatgtttgaaacttacgttatcacattatgtttaattttaatggagaaattttttggttacaagggtaaaagaaacgaaaagcaaagaaaacagaaaacgaaaaagaaaaaaagaactgaggctagagccctagggaagagagttcccaagcatcatctttagtcagttgaatcatcccatcaggaggtgagacatgaatcgtcaacacatagtcagaagccgctcccaactttgcaagaaaatctgcgcagtaatttccctcacgaagagtgtgaaaaacagaagccttgctggtaataacgaggtactttatgtcggctaacagagtgacatagacatgaaagggacattgataaggctaacagagtggagagagtcgaagtagcacacaaaatcagatattcccatatctgaaaccattcgcagaccttgaaagatggcatggagttcggccaaaagaatgtcagacgcgttggcaatgttcccggaaaaaccagagataaataatctcgcactgttcctaagggggccaccgaatccggtatgttgagggtttccaagacaactcccgtcaacattgagaatataataagagtggatgtcgcaattccattttaccacggtgtccgtggcctgagaaagagagttatgcaggaaggatgcggttaacatcaatagagttctgaatattgaatgcaagttgattaagagaccactcctcattgttgagacgcattaaattgcggtgacgccaagcccaccaaacccatgctgtgaaggtaaaagattgagtacctgtgaggccattttttaactaaacatgggtgcttgtttccgcaaagaaagcatccgaattgaaaccaaagtggcaccaaatcctggaggagtgaggacagtcacgaatacaatgaagaaaggactcatcctgctggttgcaacaggtacacatagctgattgggcaatgtttctatgcgataatagagatagagtaggagtggcatcatgacaagccagccaaacaagaaatttatatttttccaggaggtgcaaattccaaatccaggtccaagattgatgagggttggcactggtgtcggcaactgggtgggagaggagccaatcgtagccgcttttagcagtataaactccatttttgttgtgaaaccaaaacaaaaagtgtcatctatgacatcgttgaaagtgacatccgtattgttgatgttgttagcaatctcagttggaagagaggtgtaaagaatgttggtgtgaggtgcgggacaggtaaggacatccttgacggtgaggtggaggtcatgaatgtcgacataagggacgatgttggctaggtaacctgtggaggtccaattagtgaaccaaaaggaggaggcaccgctgccatgtctccaagcatagccggcggaaagcaagttttttgtacgaacaatggctgcccaggtgggggagcaactcggatgatcagtggcgaggagcaagtgtggggctgctgaatatttgtgtgtaagaaattggacccatagcttggtggagtgctgaaccatgtcccaaaccaatttaccaaggagacaaatattcattcttctagatgagcggatacccaagcctcccatgatttttggcttagctattttatcccaaccaaccaaatgaatgcctttgttgttagaatctctccatatgaaattacgtgttgtttgatcaatgctatcgcagatgctttgggggagccaattaatctgcatgtaatacgaagggataaatgataaaacagaagaagctaaggctaatctacccggtttgttgagaagcttgttcttcctagaggctaatctagtttgcattttctcaatggatgggtcaaaatggctggtgtggaaggccgggtgaacaaggttgaagacgtcatctccaacaatgtgccaatactatttaaagaagatacattgaaacccatccggaccagaggctttgtaggatttcatggagtgaagggcggctgtcacttctttcttggttatggggctagtaagtgtgtttctgtcggcatcctcaaaggtggggtggctgcctcattgaagacatggttatgatgatgatggtgattcccacataaaagatttttgaaatattttaatgaagaagcttgggtatttaaaaaagaaaatcaaggaaaaaatgaataataaaataactagttaaagttgactagacataaaaataaaaaaataaaaaataaataaaaacaacacacacacacacaaaaacacaaaaaaagatgtggaatggaatagatagatcataaaagagatgagagaaacataatagtttggcatgtttcgaacaaactgatatacttggaggagtgcaaataaaaacccaaactctctttctctttgtttttattcaattcaacaaaatccactcactcgcttcactgtcatcccaaccgctaaggaaggattgagtagcttcattcatggcaacccaatcaccatcaccatcaccatcaccaccaccacctcttccatctcccaccgccaccgatgaaaatcaaggtttcaatttctatctcctttttttattcatttcacctctcttattatcatcgatcgcactagaatccgtaattgcaccactagtatcttatcgattctacttttcactttcaataacacttttttgtcttttttcttttctttttttttaatacgaaattcttgtacatgattatcgatttatctcagtgctgcacttttttgtttaattggggaagagggagatttttattaatcaaattgacactaataccgtctccgagggatttgaagtttgaactaagtatctgagcttatacggctaagttcttaccactgagttaacacctcaggtgtctggtgattgaccatcaacaccatggcaatctcatattgtttctcggtttctcggtttctccgattcttgaagtttcccttaaactgtggtttgggatcattaaagaaaattttaattttgactttcctaaacatttctaatttttggtctcgacaatttattattttgaagaagcgtctcggcaatttatggtttcaatttccaaacagaatattagggaaagcatactttctcttggagtctgtccctaacttttagtttggaaggatcatatgacttggtaatctagtaatcagtttttgggaaatgtagaatattgtggttgtgatatttatgtgacttctaatctgtttttggtaattttctacaacttgcataattttgatgctgtcttgatttctttagcttagtcaacaacattgatcttcatttcaattggatatgttcatgtccgctattctttatatcgtttcaattggataatttcaatgtgcctcctttaaattgatctcctatagccccatttatttaagggaaatgctagttaagaagtttaaaatgggaactttaccttggaaattgtgcattcaacacattgaaagaacaaaaagtaactttttcaacataaaattcatgaatcatttctagttttgaatccttaacagggcaattgttagcatgaccctttatttaaagttataggttatttattcatgatattttatattctgactttatgtaatttagttagtttttgcaaatagactctaattcattttgagttatctagaaaataattcattggaatttatctgtaaacgacaagccccactgataacagcaaatttaggctagtaattatgtttattattttggagtttggctgataaatgggttaatatggtaatgatatttacacatacattattctcacaggccctttacgaaacctaaggtggattcgtttatttagaccgatcataacaaaacttgcaatgggacaaagtataggtgtctgaggaatttaaatatacttccatgttattctaatccaaggaaaacaaggaagctacaactttatttatattgtacaatcttttatggaggattttgattgccactttctaagacttttttaacctatacaaatacaaggattacatggaaaagagaaaaccacaagaccatcaagagaaatgagaaaatgtatttcaaatgatactctgatgattaattttaatgccaaacctcgacaactttattgttagttatatacttaatcaatagcatgacaagactaataccatttactagggtgaactgctggtaatgactaaatgaagcaacagacatgtaatgataaattatatttctcaacagattccttatttttcttataccaaagattatgttgctgtcatcattttactgtaccgttgttgaattttcccttcatggattgatagaatttgctagcagaatgttacagataagttgccagatatattgttttggttataataacattgatttgctgactctcttttttgagatttaggtgctgatattatccaaccgtcaaacatggatcagcaaaatgccggagatgagtctgttaaacccatttcatctacatcagtctttgtgaactcagaaccattgcgggaagaacaagttcagaatgctgtgaaatttctatcacacccaaaagttaaaggttcgcccgtcatgtacaggcggtcatttttggagaagaagggtcttacgaaggaggagattgatgaagcctttcggcgtgtgcctgtaagccagtgcttttttattgtaaactaattatctttcagtcagtttcccgtatgttcatctttttaatccttaccttgattaaatatcacaggattcagctccaactgtgcagacatctggtgtaactcaaggtgaaacatttaaatgttgtacttttccttcgggttgagtcagattgctcgtgaaatatatattggattagtttcgaataaactagatgtgttcttgcttcagttacattttgaacatggctattataatgctaacagatggtcaattgaagtcaccatcaaacgttcagcaacaagcccaacagcaaactttgcagccagttttacctgcttctactggtgttaatacttcatctggagccttatcacgaaccagatttcactggtcccatgcccttatgctagttggattcctgactgcttcaggtgctggaacagttttaataattaaggtattaccaccaactgttatgcatgatgccgtctaaatcagtatcttaatggctgagtgctattttctattttttttcttcctttcttgtacttgatatcttgttaaatgtacaagttttatcacattttttttatccttctgaactttaagcatacttcatgttttagaaatcacttcttcctcggttaaaatcatggatacgcaaggttgtcttagacgaagatgatgaacaatcaaagaaactgacaacaaaccaactttggttgaagaagccgctcaagctgctaaatcagcagcagccgcagctgcagatgtggcaaaagcaagccaagaaatgttggcttcaaagggtgaaggtggggtttttattggaacttttaatttgcattgtataaaatgtcttcgttttgtttttgatacctctactcttgctgagcatcttttattctgagaaattactgtaattattggctcattgtcattgcaacatctgatttatgctttgcagaaaggaaatactttgtggaagttgtgggtcttttagataagcaagtacaagaaatgaagttaatgacaaatgcaataagaagattggaaggtaatggggcattaccatttaatatattgggctgacctgaaaagtttccaatgctttgaatattttattttggttttcatttatgacttgccaatagagctcgtgtatttgttaataaagcatgtggctgtgtaattggggaacttgttatgtataaccccttaagagtacaacatggtggttcatgctgaccaagagctttgacaagttttatctatgtttttaatattgtaaatcgatttctggctttatgactgtatcaggaaagccatttattcccttgaatttgatttcataaaactgttttaggcttcctgataaattttggtggcatcatgtcacaaattattgtgtatatatgctggaattgtttaccagttatttagaattttgaagttattgttgaatatctgtttctaccaaattatggaacaaaatgtaccttcttatgatatctgtctcagggcaagaagatctccgagtcagtcaaacaagtttgaaggtcagatataaatagaactctggggactgtctcgttctcttttatgaaaaattttgcacaccttttctgatcctgatttgagttgtctattgtttaacttttgccggcatattttattttaaatacatgcagcaactggttgcgaatggcaaggcggactatgacttgcgttcaggttgtaatattgattattagatcttaactaaattagtcttattctgaattatgttaccgatcattagaatgttgtatgcagtgagatcattatccccacctgcacctgttgaaccatcaggtcctcctcatccgaagtcatatatggaggtagtattttatattgcatatttgcatgtgtagttaattgtttttcacctagttgccttgctttgccttgccttttacttctgattcatatctaaatgtttgccatttcagcattgtcttcatgtcttgtagatcacttctattataataatcaaaatataacatttagacattaattgctttgggatacgactatggattataactttctgttatttatgttgtatttcttagttttgcttctgaaaatacccaagtcagggtgggctaaattggaaatttttaactggatgaaatgaaacagtgatttaaatctattgtgatattttttgtttgtttgtttgtttgttggtgctggttaatggttattacaatcttgagtatcggttgcataattaatgtccaattaactcacctgttagctgattgaagtatttaagagtatttgcttcaaatgccattctccttattgtctcttttaattaataaatacactggtttgatccttcatgagaatgctcccttcaattcatggtactgaaccttttcttctgattttattgttatttatttttgttttcttggatatttcatttttcttcgagttgtacattttcttttctgtctctaatttaatttctcgaaactatcaaccaaatccttttcaaagacatcatatttataaccatgattaagattagctattcttgtttggattgcaatcaaactatctaagggtctgcttctccctgcaacacaagttgagtgaagcctcaaaattagtatttcctttgttttctataaaccatcagccagctttcccaatctctgctttggtataagggatctaatattgccatttatacactgattctagtagtacggtgaaaacatcaatcaaagccttgatctgctaggtagagttgattatattgatcaaacaacgccacaatatctattcatatatcatatacaaatattattcttgacatggactgagcattaattctggtgggaatataataaatttttccgaatagttgaatccattctcccctgtggtctgaattatagaaggcattatattgctttgcccattaagcagcaagctgatatgtccctgatccaagtttttttctaggagggagaaagatggcatgcattcaaacgggatgaatgtaaagactggttggttgcatgtgttttaaagaagggataaagttgaaggttgtagagggactgtcactaccttcattgcagatgaaaaaaccaatgtgaagtttttaacagttaggactttgtagctggtgttatgaaattgaggagggagtgattgtggtatcacccctagaaagtgtggactaaattgttaaagggaagatagggggtgagaagagttaggcaataattgaattctctaggcatcacaattcacagatccccaatttttatcttttatttatttatttttctgaattttcctgagaattctgtaattacacatatcttcctgagttgaggaactaatctccaatacgtatgtatatctttaatttaataatgaattctgcagtaattaatgaatgtacattttcttcgtatttgataggacagtgttattcatcttccggaatgcttgtaatattatgtttgacttttacaattatcttttgcagataatggccatggtccaaagaggggagaagccttctaatatcagagtaagccttttaatctggataaaacttaattgcatgttaaaatcataaacctgatttgtgcagcattgatataaaattataagattgattaggaaaaaaagtaattaaagtttgatatgttaggaaaggtgtcactgtgaggtaaaagattatggtttaaaactaaaattgctcttctctaataggtttaccaattttatgtggcttgttacttttgtaatactctgtgttttaatgcaggagatcaatgatttaccccccaaccctagtcaacagccgtcagatcctcgcatattgcctagatccaaggtttattaacaaatttgccttttctaattactttagttttatgaagttttttatttaaccaagttaaatacgtcttttttaaaattttgttttagttcatctttgaggattttctgttaatataactcatgcaatgattctttttttaaactttgatttggttcatctttgaggattttctattaatataactcgtgcaatggttcctagaaatttctggttctgattgctgaccatcaatgtgaaaagtataattatacaacttgtaaaattctggttctattctaacaagtatcggcaaacacatctattgaaacattaattagaaacatgaatctgattgtgtgtctcaacttctcttgggcagccatgggagattgggcaggttcaaaacacgtctagccaagtgtttcagcctcaagcaaatggtgaagaatcgtatatcaaggtccaagataccactcaatcaaatggggatgacccaactccctggtggcagaagaaaaatgtcagaatcagagagattgatgaaattgagtataatggagcaccaaatggttctgcatccagtcagcagcccctacaacgtgtgtgggttcctcctcaacctccaccgatagctatggcgggagctgcagaagcaatcaggcgcccaaaacaggctgtccaaaaggaacaggcgtcagataaccagtcagtagttcaatcttcagacatctctaatggggagcatgagatcccaaaaccgtcggaatctgaaggtgctgtagagggaagcaatgtcggctctggtgagatacaagtcttacaagaagaccatgaaacaacatatgaatagaaattaaggtgaaacatgaagttggaaatagagcttgaagtagtcccaaattctggataaactggacacagtatgtttcataaactggatatcaatacaagatgcataagtgggtgtctttttcatgaaagaatatggtactagcagaagtatgcgctattataggttttatgatgtatgtcatatttttatagttaccggctagcagctgcaaaatacccttatggaatgcgattattatttttatcatatattatcatatttataaaaaaaatactttcttgggtcaaaataatttaaaaatactttagaatattacgcacatcaaaatcaacaattaggtgactgaaatgccaactaactggtgtatgcatcaagtgcaaaattaactaagatattttataatgtggcatcaaggataatgtattaaacttaactaagaataaaaaagggcaaaattatacgattcgtctcttaacttaattttgaataacattttcgtcttttatcttttttgttctgatttagtctttatgttataaaatgacaatatcttatattttagcttttttcaatgaaatctgattttctaggcaagtattatgaagatttaggtctctttgagtttgatgaatttttttgtagttttgtattatttttggtacattttataacataaaggattaaattgggacaaaaaaaataaaacgatgaaagtgttatctaaatttaagttaagggacaaattgtgtaatttttccataaataaggtttgaactataaaatgaatcgcttctagattattttttgtgattttgttaaatccatgaagtggagattcaaagtctgagttatatgttaggaacactttctataccgttcatttttatcaaatgaaattaatgtgactttcacattttagaaataaatcctacgtaaagtgacatgacttatatgagtttcatgggtttatgaaacaagttaactacatatctttctatcttttaaatttggttaaatatgttttaatccttaaattataaatttttaagtatagtctctacaaaaaagttaattcacttttcatctctatttacattttatatgaactaaacttaaaaactcgtgattttatagggactaaaaatatatttaatctttcaaattttacactatccgcaattttgataggtgaactgtttttcatgttctgtttcatgtttcgtggtggtatacgtagatggtcacattgtgtttcatgtttttcttagggggcattgtgtttcacgattgtctctttttaatttagaaacaacaaaagtacccatatagaccattaaaccacaaattatatctttttctttgagagtaaattatatctatcttccctagcactgcaacatgcggtcatattgagaaagacttaattgcatgtttgatctcttatgttttagaagttttaagctagtcctttacgttttcaaaatttcaagttggtccaaaatattattcacgttagaataagttagtcccttcaatcacttaatgtttaatgattcgggatgataatataggtgatcgaacttaacttatttagaaaatcagttttaaaacatttttttaattttttttgttttattaaactcaatatcatgtcgtggaatggctaactgattctaatgtgagtaacgttttggatcaacttgaaacttttaaaacgtaaaagaccaatttaaaacttttaaaatataagggaccaacttaaaaactaaaataaacataagggatcaaacatgcaattaagtctattgagaaacataatcatatactttttttctcccaagtaatatgaataaatgtaaaatacaagattcgaatcaaacttatatgtatggcaatgactttatcaattcagttatgttcacgaatatatatagcgatatacttcatcacaaattaaagaaaaaaatgtaaggcggtatttgcagaagtttgcattcgcctaatgccaaaccaggaacatcaaagcatcttatagtacatttaatatattttgtttttattagaagattctcaaatcacgttcgctctcatatttcgagtgaactattaattcttaattcttgctcttaatttaatatatatatatatatatatatatatatatatattataagaccaacttgtttaatgaagtgaatgagtataaggtctagtatttaattatgtttagatatcatactacctccattttatattgagtgtcacttaaaagatatgtccacataataagaaaaatacataattatataaaatatgtatatatcgtttattttaattataagttataatcaagtatttcatttagttttacatagttatagatcagtttgagctctcaagagaaaaatactagaggtgtctcaaattaaaattctttatttgcgtgattcatatacacagcgggtagaatatagacattgcgtgttacattattattatgcaaacttcttaattaattttcgtttaggtaggaaatacacgtttcttgcttacaagttacaatccatttaaaattgtatactctgttactgataggttagggtatctcgttaataaaaagaagaagaaaaaatgaagataagattttttaatggaaaatgaagatagttgttaaagataaaaaacagaatcaaacatacaagcattaaacgattaaacaatttagaaattattcaatatttaaattatttaacagagaatagacatgcttttaaatgttcaaaaattgacaatcttaaagttccaaacgaaaatttgctaacaattgttaaacgaaaattaattcagaaaaaagtggactagcatgttggactagcatttgtcagaaaaaataaatttggactagccgcctgtcttaattctttgaatttgactcttataaaggaaaagatactaacatgaaaaataattaaaacaaggagtggtattttgatcaatgtacaatttgttatgaattttcataaaatataattattgattttttcattaatgactaatatttgtaatttcatacttatccaaaatatactaattttattattttaaagtgaattactctttttaacactatttatttaagattaaaataaaagtggttatagataaaattatttaaattattttaaaaattataattatttataatagaaaaatcagtttttaatcttctctctcatgtaccacacttggtaaaataataagataggaatatttttaacactaaaagaatataattcatttcataaataacatagtattcgataaatataggaatataatgatagtattattgatgattaagtgcatatataaatttgttgtcaaggtgttgactgcatttatttttcttttagagaattcaacatgaaagttaacttatgaacaacgataatcatctaccacaaattttaatgaattagatagtggaagagaagtatttgaaggagagaatccaatttcaatataaaattagtaaaagactcctaaaaataaatacaaacaagactgtttaaagataacttttgaattaaagaagatgattttattttatcagataatatgtagttaatgatataattcatatagtaaaaaactcatagaaatgcttaggattgaactcacaattctaatttcaacacttaattgaatggatttagctcactttcacaaacttcctaaaaaatttcaaacaataaataatgtaaaaaatggttgtgtgatgtaattgagtgagtttcacataatcacatgaaagtgaataacttactaaacaaaagtatctatctagtttgaaactaaaagagaatatatgataagtgaaccaacgatgattccacaagttggaccctcgtccatactctctatttcgtcctcattctaatctatttctatattacccactttccatttcccttacctctctttcaaaaataattaattaacaataataccctgttgttgatgctgtccgaaaccacatccattgtggattcttgtctcggctacaaatattattattaaaaactctaacccaccacatcttgttacataagaacactgcactctctttggttttttatttgttcaagctacaacatcaacctttttgatggctctgaatttgtattctccagctgaacttaagtctggttttttcactgaccccctcaagtctaaccgcttcactcctaaattcccaggttctttcttctcttcaatcctttgtgttaattagcacaaatcattttgtttatattgattgattaatgctactttgattctcaggtggtgttgctttgaaaagaaaagaaaatggaacagcatcaggaacaagagtttactgttcagtgcagtcaacatcaggaccaccaccagcatggccaggacgagcaatcccagaattaggtaacaagacttgggaaggccctaaacccatttccattgtggggtgtactggttcaattggaactcaggtactgctatatgaacccaccctctcatcaaaattgactatttcttgttttttaatgcttcatttgttactaagttttttttttctttttctttttttttgttgattcattcccccctgtatgcttttgtagacactagatattgtcgctgagaatccagataagtttagagttgtcgcacttgcagctggttcaaacattactcttcttgtagatcaggtaattacttcattcaaccatgttatgttttgaaactttggattggtttgttactatatgtctgaacacaataatttcttaaattttacatgatggattcactcccatggctattaattgttgttatattgaaaatcatcttcctgtttctgttttcaaaaacctcgtattcactcttaagcgtttacgacggatttcattattttcttctcttagaagactaaacaagttttagtttgaagttaattaattgtatggtttaaggttcagtcagtatatctcaaattttgaatatgctaccaactatgggaaaaaagattaatctcttggtatttatgttacataggttaaaagatttaagccacaactcgttgctgttagaaacgagtctctacttgctgaacttcaagaagcgttaaaagatgttgaagaaaaacctgagatcatcccgggagaacaaggcgtcattgaggtggaaatctgtttttgttttattttattgcaatttggtttagaataccaatatcgtttttcataagctattgcttttattatgcttaggttgcacgtcacccggatgcagtcactgttgtcacgggaatagtaggctgtgcaggactaaaggtaacctcttttcccttttttcggctctcttttgtaactgttttattcgctatgctacgaaagagatcttccgtgtgcgtgcatctacacgctttttaaattaactttgttaattgcatccaacaatttgaactttgaagaacattgatgttgttgttgctattatattataatatttattattattattattattattattattattattattattatttgcttgtcaaatttatttatttgaacaatgataacaagtgagtcaaataaaacaaaacaacaatgataatgaaacatcaatgataacaaccaagtcttatcttactacatgtaaaattgcaaggcgttcttatcagtcttatttttatattagggcattgatagtttgaaaggaaagtgatctacaaattgtgaagtaaagaatgtcattgtgtgtgtattgtaataatatattgcttataatggcccatattgcatgaacttggtcattgaatgttgaaaattacacacaaaaaccttgaatgtgtctttttcggttaagttagttcacacattacaaacctttgggactaattcaatagcaaaatagacattcaaggattaatttgatggctaaatgcatgtttggggatcatgtgtgtgattttcatgatttcatctttccattcatgtactattatgactgatgtgctatctttcaatgactcgtttgctgttcatttatttattagtgacaaaaatcgtagaaaaattaatcagcgagaaaagacacaactatgattgtatcactattatcacaaaatatatattagattgctgaaaatcctctcatttttttattagccaacagttgcggccatagaagctggaaaagacatagctttggccaataaagagacactaattgccggaggtccttttgtccttcctcttgcccggaagcataatgtaaaatacttcctgctgattccgaacattctgctatttttcaggtacaaaatcacatactgcattacaaaatttgtgtgtgtaacaagagtagtggactatagataccctggcttatatatttcacatattatactctggcctcaacatcttttttattaaactcgggcaattatttcatcacctgcttcatttattaatagaaaaactatttttcgcttcagtgtatccaggggttaacagagggtgcacttaggcgagtcattctaactgcatccggaggtgcttttaggtatgtaaaataaacctgagtggcagcacttttcctgtttcccatgttcagttgcttctttttatgttggatacaataaacttttttatgtatgtctgaattttgcttgctgccaattttcatatcatgatggaaacccattgatcatggaaaaccttgaatttccctttcttagttttgttgtggaccctatatgatctacatgactgtaagtatgcttcgcttcatgattaatagggattggcctgttgagaaactgaaagatgttaaagttgccgatgcattaaaacatcccaactggagtatggggaaaaagataaccgtggactctgctacactttttaacaaggtttctttctttcttatgatatatgtatgattatgtgatttaaatttcccaagtatatagtaaatttgttctacttcttttgtagggtctagaagtgattgaagcacattacttatttggagctgattatgatgatattgacattgtcattcatccacaatcaatcatacattcaatgattgaaacacaggtttagaccttataatatgttgtgttggctgccgtcttttgataatccttaatgttgttaaatattaatctaatacttaattattttttccttttataggattcatctgttcttgcacaattggggtggcctgatatgcgtttgccaatcctttatacattatcatggcctgacagagtttattgttctgaagtcacttggcctcggcttgatctttgcaagtacggttattttccccttaatttcgtttccttagttcatactgaagaaaatagacagatcccacctaggcatagagttttgaagtttgaaaatttattgtttgacagagccatatttgaaatgtgaatatgcaggcttggttcccttacttttaaagctcctgacaacattaagtatccatccatgaatcttgcctatgctgctggccgcgctggaggcaccatgacaggtgttcttagtgcagcaaatgagaaagctgtagagatgtttattgatgaaaagtaagtaatatttttgttattttactcattacaacttacaagttccggaagaattgtgctgaacattgattgcatttaaaaaatactgcagttataagaaaccttcaaaatataagttttacttccatcccaccataacctcaagataattatccatgcaaatacaaagtttttaaaacccaaaacactgactcatttccaggtttgtgagaagttattccatttgtctctccccgaatcttgctttcacaaagtatcaaaattccttcatgctgattgttaaaataataaaaaggatcagttattggcgattgcctcctatatataacttgcatctgtattcagcagggtggatatttattagcatttgtcgtggtcttgaatccttgattgtgtggccatattactttgatttttaccagcacttttcagttctttacaatcttagaagattccaagcaaaacatgactattaggaatttgtcatgttctaacgctgtctgatacgtgtgccgtgtgcatggctcctttttgaaattgacagtgctccatacatcataggttttaggctacaatatgtgtcttgttgatctaaatcattaaatccacatttaattggttattttgctgttttcaggattagctatttggatattttcaaggttgtggagctaacatgtcagaagcatcaagatgaattgttgacctcaccttcccttgaggaaattattcactatgacttgtgggcacgagaatatgctgctagtttgcaaagctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatattaaaatagaatattgagactttgggtgctgatttggaaatttttaagagtttaagagaataagcggagttaagagaaataggtaggttaaggttataaaaagagaaaagtgagaagtcagaatagttttcacgtacaaccagttttggagaaaagggagaaaacccagagaagaggaggaacgagaagagaaccttgcaatcgatttcttaaggtaagggtgggactaacattcaataatcttgagtctatgattctgaaaattgtatttaatatgttgtaggtttagtttttgagaatttgagaattagggttaagagtgatgattgtgatgattttgaatgaaagtgaagttgaataatataggttgctttttctgatttttcttttcatctctgccccgaatttgaaatgaaatctggtattgataggtacagaattggtcttaggtgtaaacacgaaagttgtaggtatggatgttagctttctaatgccattagttggacttcaaaaggatttatagaacttgagttaaggtcaaattactgcacgtaggtcacagtgaatttttatgaatttcagcacaactttttccgaatttgaaatgaaaacgggtattgattggtacagaattggtcttaggtgtaaacacgaaagttgtaggtatgaatgctatttttctaatgccattggtttgacttcaaaagaatttatagaacttgagttatggtcaaattactgcacgtaggtcacagtgaatttttatgaatttcagcacaactttgtctgaatttgaaatgaaaactggtattgattggtataaaattggtcttaggtgtaaacacgaaagttgtaggtatggatgttagctttctaatgccgttggtttgacttcaaaaggaaatatagaacttgagttatggtcaaattattacaggtaggtcacagtgaataattgaatatgattgatgaattagtatatgtatgtatatgtatatgtttatgagtatgatgttgtttatgattgatgaattagtatatgtatgtatatgttgcgaatacgatattgtccatgattgatgaagtgttatatgtatatatgatgtttaagttgatgttgattatcatttgatgttgttatatcttgagatgtttacatgctgcctatgttgctgttgctggttatgtgaaatatttatatgcgctttgtggaaaatgtatgatgtttaagttgttgatgctcttcattaatattgttatgttgtgaattgcttgtacccgtttctgttgctgttgcatattgatcaagttgcaggtgttggtctaagttgtaaagttgtaagttgtctttccaaagtattggagtcttaagttgttaatgttgtctaagttgttgaagtcgtagttgaagctgttattggtgactgtttatgttcaggtgttttgtaaaaggtggtgtactcttacgttgtttataagaggtggtgtactcttatgttgttattctttaagaggtggtgtactcttacttgtcgtttataagaggtggtgtactcttacgttgttattctttaagaggtggtgtacttttacttgtcgtttataagaggtgatgtactcttacgttgttattctttaagaggtggtgtactcttacttgtcgtttataagatgtggtgtactcttacgttgttattctttaagaggtggtgtactcttatttgtcgtttataagaggtggtgtactcttacgttgttattctttaagaggtgatgtattcttacgttgtcgtattataagaggtggtgtactctcacgtagttgtgttgtcaggttgacgttgtcgttgatgaattgttgaagttgttgataaagataaaccatggaatattaatgattatgttgttgcttatgttattataagatggtgaatatgttcttgcttatgttattatgagatgatgatcatgttgaagtttatattattattaattgatgatacttatgttgttaaatataattgttgaattatatgcttaatattattgttttgtgaaatctcaccccttctgcttggaaatgttgctcttcgtatgagtaacttgcaggtgatcgagtttaagttgctgttagattgctgtcgtgagtggattatctctcatgtgtgtctttaggtgctctgatacgtaacgggatgggaactttgttgcatgcttttctattccttacgtattgcttatgaatttacatgactaagttgttaattgaatttttatgagatgttttgataaggccttcgtgccaagactttttatgttgatgaatttaatcagctgcgaagttttgaatattatgttgattgaactttgaaggaaaattagttaattattccatttatgttttaagaaatgaagtgtgacatcccgtttgtgatgaatactctgattatttaaatgaaatttttatgttgggaaaacggggtgttacagtccacgtcatctcaaacggcaccctaggatgacatcgcatttcatggaagttaacgctctctgcatttatatatgggtgactcagtgtcgctctcaaggtacatttcacttttatcacttttcgtacataacaatctctctcaaatactgacttgattgttggagtgttaatgtgtcagcagaggagttgataaat

SEQ ID NO: 24 - DNA, 131488 bp, Medicago truncatula
  misc_feature (2119)..(2119): n is a, c, g, or t
  misc_feature (2136)..(2136): n is a, c, g, or t
  misc_feature (3702)..(3702): n is a, c, g, or t
  misc_feature (3739)..(3739): n is a, c, g, or t
  misc_feature (3784)..(3785): n is a, c, g, or t
  misc_feature (3819)..(3819): n is a, c, g, or t
  misc_feature (3832)..(3833): n is a, c, g, or t
  misc_feature (3935)..(4034): n is a, c, g, or t
  misc_feature (5587)..(5587): n is a, c, g, or t
  misc_feature (10720)..(10720): n is a, c, g, or t
  misc_feature (10993)..(10993): n is a, c, g, or t
  misc_feature (10999)..(11098): n is a, c, g, or t
  misc_feature (31008)..(31107): n is a, c, g, or t
agtgactacgaatttcgagctctggtaccctgttcttctgcatatcttcatcctttactttaatcttggtgatatcctgacctcaaatcaatcttgctaaaaacacgtgcacccactagctgatccattaaatcatctattctcggaagtggatacctattcttgatagttaccttgttcaactgtcgataatcaatacatagcctcatactaccatctttcttctttactaacaaaaccgacgctccccaaggtgaaacactcggtctaacaaacttcttctcaagcaagtcttccaactgtttcttcaactcagaagcagaaatacgataaggtgccatcgagaccggcttcgttccaggaacaagatcaatagaaaactcaacttctctctctggaggcacatcaggaatctcatctggaaaaacttcaggaaaatcacacaccaccggtaacctatcaatcactgcttgattctcaatagataaagtagccattaacgaaaacatcaagataccgtcgcgttccagttgcttcagctgcttagtagataaaaactccgcaccactttcctcttcgacggaagagaaatgcactgacttgctaaaacaattaataagaacgtggttgtactctaaccagttcatacccagaatcacatccataccgctcaaaggtagacaaactaaatccatttcgaaatcacgaccaaacatagacaaaggacatttcaaacatacgagagaagtagtcaccgaacccttagctggagtttcgacaaccatctctccattcatatcagacaaatcaagacccaaagcagaaacacaatcgaaagcaataaaacaatgcgtagcaccagtatcaataatagcaactaaaggagtattattaatatagcaagtacctctgatcaaacgatcctcattctctgtctgagtcccagtcaaagcaaagactctaccagtagtcggcgccctcttaggctgagtacactgtgaactaatgtgaccctctccattgcaattaaagcacacaatgtctgtacgattgcaatcagctacaacatgacctttcttaccacaccggacacacttcttgatttcctcggggcaggcgttgctcttgtggcctttctcaccacaattgaagcacacaatctctgcagcatccttcttcttaggccgcctaacatcgaccatcttctgtttacctttgtcagcgggggcactgtacggcttaggacgactctgctgtcccttgcccttcctttcattcactaccttgtagtgagccttggtatcctcctcatagattctgcagctgttaaccaaatcctgaaaaactctcagttgttggtatccaatcgcccgcttgatgtcgagcctcagaccattctcgaacttgatgcatctcgagaactcagcattctcagcagtatagtgcggatagaacttagacagctccacgaacttggcagcatactctgtcacggacatatttccttgcttcagctcaaggaactcgatctccttcttcccgcgaacatcttccagaaagtatcttctcaggaactctctcctgaacacagcccaagtcataacagctccctcctgcccaagggtaggcagaagagcaacccaccagtcatcagcttcctcggctagctgatgagtaccaaaccgcaccttctgttcttcagtgtactgcataactcggaaaatcctctcgatctccttaagccacgtctgggctccatcagggtcataacgtcctttgaaagtcggagggttcttcttcatgaacgtctccaacatcctagcttcagcattcgcaccagcattcacgttaggttgttgtcccacagcttgggcaacagcttgtagagcagcagctaacgcagcatcgtttcttccagccatttctgatattctacaaaagtagcaacaacaacataagatagtaatataaatattactaagactcgacacgactctctaattgaccggaccgaccgacctgctctgataccaattgtaacaccccgttttcccaatatctaaaatttctttaaaagcataacatttatcagagtaagcatcaagcaacgggatatcancatatacgtaatccagncagttaataataatttacccaatatcttaaacatttgcagcggaaaatcataaacataaatcataaacgttttggcacgcaggcccaacaagtatctcaaaagagtttatcaaagcataaattatcatggcagttcacgtaaaagaatgaagcatgttatagcattaaccccatcccgttacgtatcagagcgacctagacgacacagtgaggcaaggccactcacagaagcaactgcacactaagcacgatcacctgcaagttacccatacgaagggcaacattttcaagcagaaggggtgagatttcataataaaataacattaatcaatgtaattgcgaatcataaattaacatcataatcattccattattaactttgcataaatgctaaacagttatcacgtaatcatatatccaatcattataaacaacataacataatcaatgaacacttatcatgtaatcacatattcattcatcatcaacaaggcatcttaatcatgacaatgtgacaatgctcctagactccttatatgcatgtggtaccaatcgtcatcataagtattaatatactttaatcgtgcggaggacaaagctcctataaaacgtgcggaggacaaagctcctaatattcgtggtgaggactaagctcaatgatatgctatgcatggacacatatgaacaaaacatcgtaatcacttatcaacatgcatccaataatttggagctaaacttcatcatataattatgcacttagttaaataacggaagcagcataaacaggtcacataacaagatgatatcattatatcaaagcacataatttgtatcattatcacatcttcttatcttgcatgaatatacaatacaatagttcatattcaattaatattaatataacttaaacaactctacagtttgcattaaacgacatcactaggtctcattaccagttaggggttcacagatcgcataaacacataaacaagctcttcctggttgtactcgcgaggcgagagtacttactcgccatggcgagtaccactcaactcccaaactaaggttgttctgggttccctctgatcctacattcattcctaatcaatactaggtatgttcaggtactcaaaggcatacaagattcaactaaaaaggtcgaaacacgaaatatgacatgcactctgcctaagctcgcgaggcgaggaaaggttgctcgccatggcgagttgcaccaaacaactcgcgaggcgaaggaaaggggcttgcgtggcgagcgatgaagttcatcactcgcgaggcgaggatcatcactcgccgtggcgagcgatgaatagaagcacgggcagacttgggtttttctcaaaaatccatcacacaacatggttcaaagcctaattttgattccagaattcatcctaaacatattctaaggttaaaggacggttctatcattaatctaacaagtcttaccgtttgatcatcaatttatagggttttgacctaattctaaaacttctctagatcaatcctaactttggtcactaatcatcagaattacagcanttaacattattgagttattagtctcacccttacctgnttatgaagaaatcacagccctctctatgctcctctcccttctaanngctttctccttttttttccaaaagtttcacatancatgagtttctannatattaggttctctcctatttatatctcttccaaattacttatcttatctcgcttcacccccaaactatttaaattatcaaagggcctcactaaattattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgagctcggtaccagattacacttttgtggtatattgtgatgcgtccaagttgggtttaggaggtgtacttatgcaagaaggtaaagtggtagcttatgcttcaagacagttgagaatccatgagaagaattatcctacgcatgatctcgagttggcggccgtagtctttgtattgaagatatggagacattacttgtatggttcgagatttgaggtgtttagtgatcacaagagtttgaagtatttgttcgatcagaaggaattgaatatgagacagcgaagatggcttgaattgttgaaagattatgactttggtttgaattatcacccaggtaaagctaatgttgttgctgataccttgagtaggaagacattgcatatgtccgctatgatggtcaaagatttcgaattgcttgaacagtttagagatatgagtttggtttgcgaatggtcacctcagagtgtgaaattgggtatgctgaaaattgatagtgaatttctgaaaagtatcaaggaagcacagaaagttgatgtaaagtttgtggacttgttggttgctagagatcagactgaagacagtgattttaaaatcgacaatcaaagtgtgttgagattccgaggaagaatttgtatcccagacaatgaagagattaagaagatgattcttgaagagagtcatagaagtagcttgagtattcatccgggagctacgaagatgtatcatgatttaaagaagattttctggtggtctggtttgaaacgagatatggcacagtttgtgtattcctgtttagtttgtcagaagtcgaaagttgagcatcagaaacctgctggaatgatggtacctttagacgtgccataatggaaatgggatagtatatccatggattttgtgacgagtttgccaaatactcctagagggaacgacgcaatttgggttattcttgatagattgacgaagtcggctcattttctaccgattaatattagttttcccgttgtccagttggcagagatttatatcaaggagattgtgaagttgcatggtgttccttcgagcattgtgtcagatagagatccaagatttacttctagattttggaaaagtttgcaagaggctttgggttcgaagttgaggttgagctcggcgtatcatccacaaacagatggtcagtcagagaggacaattcagtcgctagaggatttgttgagaatttgtgttcttgagcaaggaggaacttgggatagtcatcttccgttgatcgagttcacatacaataatagttatcattcaagtattggaatggcacctttcgaggctttatatggtcggagatgcagaactccgttgtgctggtttgagtcaggtgaaagagtagtcttaggaccagagattgttcagcaaactactgagaaagttcagatgatccaagagaaaatgaaagcgtcgcagagtcgacaaaagagttatcatgataagcgtaggaaagatcttgagttccaagaaggagaccacgtgtttttgagagtcactcctatgactggtgtangacgtgctttgaagtcaaagaagttgaccccgaagttcattggtccgtatcagatattggaaagagttggaacggtggcttaccgagtgggtttaccgccgcatctttcgaatttgcacaacgttttccatgtgtcgcaacttcgaaagtatgttccagatccatctcatgtaatccaaagtgatgatgtgcaagttagagacaaccttacggtagagactttaccggtgaggattgatgatcgtaaagtgaagatgttgagaggtgtaacgcccactttcgtttaatcgttatttgatcgagtttaggcaattatatgataattatataatatatacatgattttgatatattttgatgattttgatgatttgattgatgacgtgataagttatgagttttggaggatttgataagattagagaatttattttattgttaaataaaataaagatttgaaaataatataaaatatttagttgagggctgttttaatattttagataattttgggggtgaaagtgagataagataagtaatttggaagagatataaataggagaggacctaatattttagaaactcattgtacgtgaaaacttttggaaaagggagaaaagcttagaagggagaagagcatagagagggctgcgatttcttcataaccaggtaagggtgagactaataattcaataatgttaattactgtaattctgatgattagttgacaaagttaggattgatttagagaagtcttggaattaggtcaaaaccctaaaaattgatgatcaaacggtaaaacttgttagattaatgaaagaaccgtcctttaaccttagaatatgtttaggatgaattctgcaatgaaaattaggctttgaaccatgttgtgtgatggatttttgagaaaaaccctagtctgcccgtgcttctgttcatcgctcgccacggcgagggatgatcctcgcctcgcgagtgatgaacttcatcgctcgccacgcgagcccctttccttcgcctcgcgagttgtttggtgcaactcgccatggcgagcaacctttcctcgcctcgcgagcttaggcagagtgcatgtcatatttcgtgtttcgacctttttagttgaatcttgtattcctttgagtacctgaacatacctagtattgattaggaatgaatgtaggatcagagggaacccagaacaaccttagtttgggagttgagtggtgctcgccatggcgagtaagtactctcgcctcgcaagtacaaccaggatgaacttgtttatgtgtttatgcgatctgtgtcgcacttgttgatcaagagtgaacccctaactggtaatgagacctagtgatgtcgtttaatgcagactgtagagttgtttaagttatattaatattaattgaatatgaactattgtattgtatattcatgcaagataagaagatttgataatgatacaaattatgtgctttgatataatgatatcatctttatgtgacctggttatgctgcttctgttatttaactaagtgcataattatatgatgaagtttagctccaaattattggatgcatgttgataagtgattacgatgttttgttcatatgtgtccatgcatagcatatcattgagcttagtcctcaccacgaatattaggagctttgtcctccgcacgttttataggagctttgtcctccgcacgattaaagtatattaatacttatgatgacgattggtaccacatgcatataaggagtctaggagcattgtcatattgtcatgattaagatgccttgttgatgatgaatgaatatgtgattacgtgataagtgttcattgattatgttatgttgtttataatgattggatatatgattacgtgataactgtttagcatttatgcaaagttaataatggaatgattatgatgttaatttatgattcgcaattacattgactaatgttattttattatgaaatctcaccccttctgcttgaaaatgttgcccttcgtatgggtaacttgcaggtgatcgtgcttagtgtgcagttgcttctgtgagtggccttgcctcactgtgtcgtctaggtcgctctgatacgtaacgggatggggttaatgctataacatgcttcattcttttacgtgaactgccatgataatttatgctttgataaactcctttgagatacttgttgggcctgcgtgccaaaacgtttatgatttatgtttatgattttccgctgcaaatgtttaagatattggttaaattattatttaactgttggattacgttatatgtgatatcccgttgcttgatgcttactctgataaatgttatgcttttaaagaaattttaaatattgggaaaacagggtgttacaagaggcaaggagatacctctcgtgagagtcgtttggacgggagcgactagtgaaagcttgacgtgggagctcgagagtaagatgctggagtcttatccagagttgtttgcttgaggtaaattttcgaggacgaaaatcttttaagtgggggagagttgtaatgcccactttcgtttaatcgttatttaatcgagtttaggcaattatattataattatatagtatatgcatgattttgatgtgttttgatgatttgtggtgaatttagtgatttgattgatgacgtgataagttatgagttttggaggatttgattatgatatgggaattattttattgttaaataaaataaagatttgaaaataatataaaatatttagttgagggctgttttgatattttagatagttttgggggagaaagtgagataagataagttattagaaagaggtataaatagggaagacctaatattttagaaactcattgtacgtgaaaacttttgaaaaagggagaaaaagcttagaagggagaagagcatagagagggctgcgatttcttcataaccaggtaagggtgagactaataactcagtattgttaattgaatgtgattctgatgattagttaacaagaattaggagtgaattggagaaaacaaaactaggtcaaaaccttagaattgatgatcaaacggtgagaattggtttaattgatgtagaaagtgttcctagaccttagataatgtttaggacgaactttggaatcaaaaacaagcttagaaccatgtgaaacgtcgagtttttgtgaatttaggaagtctggccgtagcgacattcatcgctcgccacggcgagcgatgaatctcgcctcgcgagtgatgaacattcatcgctcgcctcgcgaaccctgttttctcgcctcgcgagttgtgcaatgcagctcgccatagcgagcgaccttactcgccatagcgagctaaggcagagagcatgttagattttgtattttcgactttttagttggaccttgaatgccttagtgtgcctgaacatacctagtaatgattaggaatgaatgtagggcaagattagacccaaaacaacttgagtttgggaattgtttagtactcgccatggcgagcaagaaccctcgcctcgcgagcacctccagccttgagtgttatgagtgtttatgcgatttgtatcgcacgttttgatcaagagcgaacccccttatgataataagacctaatgatgatgttaaatgcagtctgtaagctgtttaagatatgttgatattgattgagtatgattaaggtattgtatatttatgtaagatatggaagttgaattatgaaataattgatgtgctattgatataatgatatcatcctgttatgtgacttgattatgctgctgctgttatttaactaagtgcattgtatatatttatacatgatgaaatgatgacgtttagctccaaattgttggatgcatgttgatatgttgattacgatgttttgttcataagagtccatgcatagcatctcattgagcttagtcctcaccacgtttattaggagctttgtcctccgcacgattattaggagctttgtcctccgcaagattaaagtatattaatactcatgatgacgattggtaccacatgcatataaggagtctaagagcattgtcacatagtcatgtccataatgctatgttgttgatgacgattgaataagtgaatacatgatatttgtttattgaatatatgaatacgtgatacttgttatttgaatatgcgaagctatccaagaatgattatgatgttaatgttaattatgattcgaattactttgattagcattattttgttatgaaatctcacccattctgcttgaaaatgttgcccttcgtatgggtaacttgcaggtgatcgtgcttagtgtgcagttgcttctgtgagtggccttgcctcactgtgtcgtctaggtcgctctgatacgtaacgggatggggtttatgtttatgcatgcttcattctcttacgtgactaatatgttatttttataatgttatggattgtgattatcaacttttgatggggcctgcgtgccaaaacgttttatgaattatgattatgattttccgctgcaatgtttaagatattggttaaattattatttaactgttttggattatgttttatgtgatatcccgttgtttatgatgcttactctgataaatgtttttaagaatttttatgttaggaaaacggggtgttacaggtatcagagcaggtcggtccgtccggtcaattagagagtcgtgtcgagtcttagtaatatttatattactatcttatgttgttgttgctactttttaagaatctcggaaatggctggaagaaacgatgctgcgttagctgctgctctacaagctgttgcccaagctgtgggacaacaacctaacgtgaatgctggtgcgaatgctgaagctaggatgttggagacgttcatgaagaagaaccctccgactttcaaaggacgttacgaccctgatggagcctagacgtggcttaaggagattgagaggattttccgagttatgcaatgcactgaagatcagaaggtgcgatttggtactcatcagctagccgcggaagctgatgactggtgggttgctcttctgcctacccttgggcaggagggagctgtaacgcccactttcgcttaatcgttanttaatcgagtttaggcaattatattataattatataatatatacatgattttgatatgtcttgatgatttgtggtgattctgatgatttgattgatgacgtgataagtatgagttctggaggatttgataagattagagacttattttattgtcaatacaataacgattgaaattatataaatatttagtgaggcccgtttgatatttaaatagttttgggggtgaagcgagataagatagtattttggagaaatttaataggagaaaactantattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctggtaccagtaatgtaaactaaactaaactaactaaatttattacaaaccagttggcatctcaatgcatccaaaaagcaaacctaaattaggcgcaatgcgggtccaaagcttaggtgcttatggaacgcatgctctctgcagcatcagcgttagtaacacaagtacaaaatgataataataaaaaaaaagctgcaagcaatatatcattgaatcgcacaagcgcaagcaaataatgcaacgaaacaaagtagtaaaaataatgcaagcaatgttgaattgaatagcacaagagaaagaaaataatgcaatgaaacaaagtagtaaaaatacacctagaatttaggtataacactcatacatgcatatgacctataattccctcattatagccatttttgaaaggtttgaatttaagctacaatgtgaggatcataagagtacacacaagcaaagcattatatcatattcctagagatattttcacacattatttcacatgcaaaaatatcataatatgtaaaaaatgcatcaagaacatatatggaatttaatgagcaagaattaaaagaacaaagtaaagaaaataaatgcaaaaataagcaaataaattctaacacttagaggaaaaattaaaatgatagggaaatatttttagaaattttttagaagcataaaacaccaagaaagtgtaaaaaagtagttaaaacacaattaaaaagcaattaaaaagaggctcaacaggatttaatctggtccgctggatgaatccagaggtccagatctaactcccaagatcacatcacagccactggatcaaagatccaagggtccaaaaaaaagcacaaaagatagtgtaaaatgcaggaagcacagtgaccgttagatcaaagatctaacggttcaaatagaagatataacatattccacacaaaaaatcacacacaggattcaaaatcaaaaacacagcagccatcagatcttggaacaatccagatctgatggttcacagagcgaaggaacaccacagaaacatgcacgcgcgcgtgggaacgaagggagtatataaaggaattttcacacaaaaaactcacaaaaacaaatctccttctctctctaagtcccacttagagagagaagctctcccctctctctaagaagctgaccggagaaggtggaggaggaagctccggcgcggcggccggccggtttccggcagcggcaccaccgtgcccgaaaaatcaaactactttttttttcaaaatttttataccaaaagcttcgtctcctcctcctctacacaaatccggcactagttttagaaagggctgagagatttgggctagatctacacttgaacttcgaaaaaatttcacactttttttgaaaaataactacggatctagatatccttttctttatagagtccgaatccggtctcggaatttctaaaatccgaacgtacaagcctagatctacaaatacatatccgtaacaaactttttcacactttttctacactatatgcgcgcgcgaaaatgaagaaaaagaggagagaaatgcgttacctctgtcgtagaacggagaaaaatcttcggaaaacttcgaatctcccttttccccctccgtgcgcgcgcgtttcaactccgtttgtggttgtttttgctcaaaaatccggtacgttttggtgttgatgtgatgattcgcggtggttttgagtgaatctggttcggatttgttgattttgtggtgattggagttgattctgagcagatccggtttagatctgttgattttggtgatgatgtgttcttggtgttcttcctcttttttctgagattttttctgttttgattctgttatggatgagagagagaaaaagattctgtttgagactgattgtgattgattctgatttttttttctgactgattgtgatggatctgacacatttactatttatagcctgccatgtgtatctgagaaccaatgaaaaaatgacatctgttttgggactgatgtggatcgaaaatctggactaaaatgcccctgggacctttctgcaaaataaaaaacttgaaggactggactgcaataaaagatggactaaaatgaaatttttaaaagttttggacccaaaacgtgattaaaaataaaattggactaaaaagtaaatttgacgaaacgtaaagcgaaaccaaaaataaaatcaacaaaaggactaaaacaaaccaattactgacatgaggtattttaaaatacctccctgtcgaaattttgacaggaaaagaccaaaatgccccccagggactaaactgatccaaactgactcaaatacaatttttgaaatgatttttaaacaaagactcaacaatgatttgtacagaaaaattgaaaagactcagaggcaaacacagcgacaaaaatgggttccactgcaggaaatgaccaaaatacccttttgtatgatttttttgaaataaaatgcaagaaaagtaatgcgacgtttcagagagttcttaaatgacttgtaatgtcagaaaagacagaggcagtaaaatacgtttaaaaagagagtaaagattcagagtaaaataacagagaattgacaaatatcagtgttagaaaagaaatttgaacgagtatttttaggtccaaaatcagggtacaacagctgcccctatttaagtttctttgttcggagggtcaagagacggagtctttggcttgacgggacgaagatacttaaatattaacatttgcactgtgtttggacgtaaaaatacgcttgtacattttcaaacatcatgaatgccatgcaacatttggattatgaatgcgagacaaacgagagttggaactaacaaaagatgtcgtatccattgcgggattggtagacattggtaagttaacagataacagggtagataggagactaggaacaaattgacgggtacaagctgctcttggattgagctgggcacttgacctggaataaaagcggacaaacaggtgcgagttgttcttggattcgaactggtcactcgaccggggacatagaaaaggtagacaggtacgagttgttcttgattcgaactggtcactcgactgaaagcaaaggaaaatagacaggtgcgagcttgttctcggatgcgaactggttactccaccggagacaaagacaaaatagacaggcgcaagctgctcttggatcgagctagccacttgagcgaacagaaacagatagacgggtacaagctgttcttggacttgaactagccacttgaccaaaatcatagacacatagacaggtacgagctgttcttggattcgaactggtaactcgaccgataacattgaaaagtaaacgggtgcaagctgctcttggattgagctgggcactcgaccgataacataagcaaattgataggtacaagctgttcttggacttgaactagccacttgaccgaacagagacaaattcacaggggattagttttttgacaaaatataggttgaaattgacttgacgtcgatttgatttgaaaggtagaaattgaccaatattattggctcacaaggttttgacagagaacctgacatgagtattgaattgagactgatgttgacattggaaatgcaatatgcatggatgatataacagtttcattaaatgcatgggcacgtaatatgcatgattatgcatgtatgaatgcttgtaatgcatgactgttggcagctggtagacacagtttcgcagagacagacaagacattggagtattgggcacgtagtggctcgtgctatattacacattcttggaaatcctctttggagatgaagtcgttgggagacgtatcggaaccatggctgagggcaggtagctatgcaacttgctggggatagaatctcggaagactctactgggaataatgtcggatgtatcgtggatgtcgcatctgtggtcaatgctttttgcatgttattttctcaaattttcattcatcattttttttgcatcccatttttgcctggatcgccctttcgggttttcgatccaccgggaaaataaattcttttcaatgccccatttttgcctgaactgccctttcgggttgtcaatccagcggggtgctcatttttgcctaagccgcccttccgggttttcaacttagcgagcctattcattttcatgcattttcattctgttttttcattcttgccattgaccacagactatcctggaggagaacctgcttgtaacatatattgaaatagacaccaacatacactcgctcatgcatgtttcgtttgaatgtaccctgttgctcaggtttgcttttcaaaaaactttttcaattttcaagatgcttgtttcgagcatttgtcattattaaaaatagaaggaaaatgttttttgaacataactttgaaagtaaaaagaaattagagtttcaaacaaaagcacaggctcaatttgatgtataagggtggtggtcagccgaaggcgtgactccacggatttacaaagcttggaaaatggtaattttattggttggtggtacattgaacacaacaatcatgacatttcctagaaactttgaattcgcaagcataagagcttttgatgaagatggtcattaacagctgcagatgcccccagggaacggtggttggctagatatagttacttgccttttgtttcaatctcatttttgcatgaaccgcccttccgggttttcggctcatcgagacgctcattcttgcctgagttgcgtacaatctcagcgagctttttcatatatttttttgtcccttatttttgcctggaccgccctttcgggttttcgatccaccgggaagcgcatttttgcctaggccgccctttcgggttttcgacctaccacgctgttcttttcatatttctaggcaaagtatttcttgactagatcagcattcacaggatttggaagttctacaccatccatgtgtgtaagaattaaagcaccaccggagaaggccttcttgacaacataagaaccttcatagttaggcgtccacttgccccttgggtcgggttgctggcttatcctccttttcaatacaagttcaccttccttgaattctcgaggatggactttcttgtcaaaggcagtcttcattcttgcttgatatgactgtccacgagccatggcatccatacgtttttcctcaaccaaattcaactgatcataccggctttggcaccattcggcctcggataactttgcttccatgatcacacggagagatgggatctccacttccaaaggaagaactgcttccataccatatacaagagagaaaggggttgccccggttgaactgcgcaccgtagtgcggtagccatgcagagcatatggtaacatctcatgccaatccctgtaagtggttaccattttctgaacaatcctcttgatattcttgttggcggcctcaacaacaccatttatctgaggtctatagggagaagagttatgatgctcaattttgaattcttcacaaagagcttgcaccacattgttgttcaggttggtaccattgtcggtaatgatcttgctgggaacaccatatcgacagatgatgttgttcttgatgaacttagctaccacttgcttggtcacattggtataagatgctgcttcaacccacttggtgaagtagtcaattgccactaagatgaaacgatgaccatttgaagccttcggttcaattcttccaatcatgtcgatgcccaccattgagaacggccatggggatgaaataacattgagagcgtgcggaggcacatgaatcttatcagcatagatttgacatttgtggcactttctggcgtgctggtagcaatcatgctccatggtcagccagtagtaacctgcccgtaacagcttccttgacatagtatgccctgtagcatgggtcccgaaggtaccgtcatgtacatcatgcattaactgctccgcttcgtgttcatcaacacatcttaataataccatgtcatagtttcttttgtacagaatatctccatctaacaggaatctactggccaatcttctcagggtcttcttgtctttgttggaagcacccggtggatactctcggcttagcaaacactgtttgatgtcgtaataccagggtttattgtcaaccatattttcaccagcctgatcgatcacatccccaatagtgaacacatgtgaaggtctttcaaggcgttgcactttgattattggcacatcattccaatggtttactcgaaacatggaggatagagtagcaagagcatcagccatttggttctcatcacgagggatatggtgtagctcaacctttgtaaaatatgtcagcaaacgcctcgcataatcacgataaggaatcaacttggcatggtgggtctcccattcaccctttatctggttgatgatgagtgcagagtctccatagatgtcgaggtgtttgattctcatgccaattgcttcctcgatcccaaagatacatgcttcatactcaaccatattgtttgtacattcgaacaaaatctgggcggtaaaaggaatgtgatgcccctgcggggatacaatgactgccccgattcctttaccataagcattggcagcaccatcaaagactaaaccccacttgctattgggatctggaccttcaccaatcaacggttcttcgcagtcttttgatttcaaatacacgatctcttcattggggaaatcggactcaattggttggtaatcatcaagaggttggtaggcaggatgatcggcaagaatgctacctttgattgccttttgagttttgaacacaatatcatattcagacaagagcacctgccagcgtgcaatcttcccagtaacaacagctttctcaaagatatactttatcggatccattctggatatcaaccaagttgtatgattcaccaaataatgacgcaggcgtttagcggcccaggccagagcacaacaagtcttctcaagcattgtataccgagtttcacaatcggtgagcttcttgcttagatagtagatagcagtcggtatacccaagttgatgatctcgatctcttcctggtgaggctgaatggctcttccttcttgttcaagcagtcgagtgatctcatatggtatgtcatcaccttcctcatcttcggcctcatacactgggaattcaaaattcggagggaaagcagggttactgtgcccaacgggtttattatagttcaatctgcgtaaaatgattggatgattttagaaggaggttttttatgcagatttttgaaattaataagaaaatacagatgttttggttttttctggcattaccattatttccaagggaaaaagcactaaaaaagcagtcgtggaagaaacgacaaaatttttattaatcaacggcaatgccgaaacaaacatgcccttacagaaaatatcactctcgctttgggcagagcgagaggattgttattttgaaaaaacaagatacttaagcaacaaggtatattactcagaaacatgcatgattgagggaatgtcaatggcatcccaatctctcgcaatgcctcctggtataacaaatacaggcctcgggccaaatccagttgcttcttctgtaattgcgttgacaaacccagcactatagaatgccccggtggaaactcctgaagttggggaaaagccaagaccttccttatgcttgttctcacgaagctgtattaacctgccctagccggcagcttgaccctcttggacggctctctgtgcatccttcaaagaagccattgcagttccatccctcttgggctccgtaccttcgatagttaatccttgaaaagcggtcccctctgcagaccctgcctctatgcaagagaaagatgatagctggctaaccaggtatgcttcctctccatgaatggtaacaagctttccactttttgcaaatttcaacttttggtgcaaagtagaggtcactgctcccgcgtcgtgtattcatggtctccccaagagacagttgtaagaggcattaatatccatgacctgaaaggtgattagaaaggtttcgggaccgatagttattggcaagtctatctccccgagaacactcttgcgggttccatcaaaggctttgaccagaaaagtgctcctcctcaaaggagttccccggtaactcagctgatccagcgttgacttgggcatcacgttcaaagatgagccagtgtctactaatacatttgagattatgtcgggcgtgcaattcacggagatatgcaaggccagattatgatgctttcctgcttcgggcaattcattttcactgaaccacaggttgctacatgcggtaatgttccccactatgctaccaaagtgatccaacgtaacctcatgatccacataagcttgctccaatactttcaaaagggtatctctgtgggcagcggaactcaggagtagagacaaaatggatatcttcgacggagtttgcagcagctgatctacaatcttataatcacttcttttgatcaacctcaaaatctcgtccagattagaatcctctatagaccggcctggttggctcgcgtctctgttaacgggagaaacatcagtcggggttggcttgtcaatgggtggcacggtaggcgtagctgccttcttttgaaacaacggtggacggactcttccgcttcttagggctgctgaagttccttcggcagtattgttcaccacggccaaggacaccagaggcacttctactccgttttcgattatggtagcattatatttgtacgggatagccctatctgaagtatacggtaccggtccgggcaaccttatcaccaaaggctcagcattctccttcaaaggcatactcttgacaggcggatcgtgaaaaactggcacaatcacgcagacatcactaacagtcaaaaaattatcattcatcaagctttggatgtcatcttgaacagtgtagcaacccaaaggattacgaaggcatcctaggcacttggcatgatcatggctgaacagagaagctttgcacagcttgatgtgtagaggcaccagaggagttgcgacgttacggacatcaagtctaggagcttcctcacatacttcgatcatattcacagcggcatgatttggaagaggattgtcgaggacgtgtgggacattattcttaaaagtcagctttccttgatcaatgagctttttcacgatatacttcaaagcatagcacccctcgacatcatgacccagggcgccttgatgaaaatcacatttgagatcggacctgaaccttggaggcaacggatcaggtgggggcttgccctgtctggttgtacaatgccctctatggagtaaagtcggaagcaactcagcatataacatcggtatcggagggaaagtaggtctagcttgctgattttgttgttgttgttgaactggcaactgttgtttctgaaggtgaaaaacacaagaagggggggttgaattgtgttttctttttctcttaaaaaaaacttcttctgataaaacttcagaagcagtttgattgcttctgatgaaatgatcagagtcagattgcagcggaaaagaacagagcagagaaaagaaagacaaagacacaggcagttatcctggttccttccacaacacggaagtagtccagtcccccttgcacttccaaggagatttcactataatcacaagattacaactgctcaatactttctaagtatgagacttcacaaaactatgctcaagcacacacgcaagagtcttccaatgctcaagcactaagcaagagacttctaatgctcaagcacgcaggcaagagacttctaatcaaacaaaaatacagagaattgagtttgaattgaacacttgatatacaatcagtggtgttcacaatacaatacagaaaagactctagactttgaatttctaagatgtatcaaatcagtgcagaaattcagtgtgcttttgtagaatcaaattgacagagttttggcgcttttaaacttatatatctctatctgcaatcttcaagtcttcactcctttatatagaggcgtgaaagagacgttgagataatcagcacgtctaaagagtcgtttgaaatcctttgattatccaccagtgatcctttgcctgatttgggtgtagtcctttgaagaataagcttcaaattcattcccatcttgagtgtacaattctgcaggcatggctgttgttttgtcttgtagcgtagacagaaaacagagtagtggaggtagtggttgtacacttgtactttgtcaactctattaacgagagacaagagctcagtgctatccatatatccgttgatacctccctttcaattcttcgttctccgttgataagactgaattgagaatcagctactttgaatcttcagtttgattaaaggatcaaatgtagcttctggtgaagatattgcttctgatgaaaacttttgcttctgatgactttctgcttctgatgactttctgcttctgatgacgtcatctcttcaggagcagttttcttcagatgctcagaatttctttttctttccattgttcttccaagacctattgaaataacttgagtagcctttggtcctgtacacttgaacaattattagtaataaccaattgacaatttttaataccttgttatcatcaaaacttaataaggttcattgtgaaacacattttgttccaacagtttcatctgttgagcgattgcattaacgggtacttgaggttgacccggtggcagggggtactgatgataaaatggcggaaagaaaggatgctgagaatacggcacatatgggtatgacggaggcatttgggttgcattgataggagcaacagtagccatggattgaccggctccagctgacaccatccctacttccgtttctttcttcttgtggtgtccattaccatacctctttgatgcattcacagaggattcagctttctcgaacacaatgattccttccctgacggcttcctccagacgggttcccatggtgaccatctccgaaaagttattcggggcagcaatgatcattctctcaacataatccttcttcaaggtctttaagaatgtctgggtcatttcttcttcatcaagagcgggagtaatgcgggcagctgcccctctccatctctgtgcgtattcacggaagctttcctccttcttctgggagagagatctgaggaattccctgttcggcttcaatcgggtgttaaacccatagtggctcttgaaagcagcggctaattcatcaaaggtatggatgtcatttttgctcaaactagtataccactctgcagcatcttccatcaaactatcttgaaagcagtggatcataagtgaatcattgtctttgtaattgcccatctttcggacgtacttgatgatgtggttctggggacaagtcagcccgttgtatcggtcgaaatctgggattttgaacttcttagggacatccacctttgacaccaagcagagatcttgagttttgaaagagtccgcattccctcgattggctttgatctcatgacggagttctttagcaagttcctccatcatctcttccatggttttggttacggggatgcttccgtgctgtgtgttgatgttaacaccttggggtatggcatgcacaagaggctcggtgacagctgccgttgtttgtggcaaagtagcattgatggagacagcatttgttgcagggatcagaacattgttagcagtgcccgaagtgcccgctgcagtactgggagtgaagaacggtggaagcccatatggaaacccagctggcatagcaaagcgagcgtctgcagatgcggttgggagcatgcttgtagtcaccggtatagctgtggctatagggatagccgtggctgattgttcttgagcggctagcagagcagtcatgacatcattagctttagccaattcttcccttagagtggctaactcggtacggagctgagcattctcttcttccatggctgccgaattcttctttctgtagagtctagtccggtgtattctgtctgattcgtaaactttccgagcacgagccacctttcaatctctgtggcagaagaaccaggaggcagtgagcacttgtaaaccttttgtggcttgatgaatgatgcacatgatgcatgatatgtacaaatgcaaatgcaaaagttgtttttggacatcgaaggatttttagacaaattaggagttttgtaaacaatatctaaacaagcaaagcaaaacgaagcgtttacaagatgaatccctttgaaatactaagccaagggaagacttttgaaatataaacaaataaaactctcaagcataggaagtggtgggatgatcctcagactcagtctccgaatccgaaccgcagtatctagcatagaagttgcgtcgtcctctagctctcttggagtcccgcataagtagctcatccttttcttcaagttcccttcggaccttaaccaattccttcttcaacatcaggttctcatgagtcttctgctcatccttaccatccaaagtcatgattagattctcagcctcattgtatcgggccttccacatttgtttctcacgactttccatggccagatgctcctaatacatctcctgagtagtgggaggtagaggtaaaggtatagatggagcagatgcagccacatgtctcatagcagggtatggcataccaatctcttcggctcggtttattacccactgagtataggcctcatgagcaataccagatctcacacccaaatgcttcacactcttcctacggaccttagaccaagcccttgtgaaagcctccctttgtccggtgggggcgttcgaataatagaagaactccggagatgtggcaagattgatgggctttgtcttcatagggaacccaaactatctcatagcaagctccggattgtagttgattaccccacgggtaccaagaagaggtacattgagaaagtctccacaaccagtaataatttccttaacctgagcggcgggagtgatccagaccacctcgttaggagagagagccatcatccgctgtgagtaggaccaatcctccgagttatcatggaaggagctcggaaggtgagaaataaaccacctatataggagaggcacgcagcaaaggatatacccacgacctttgagagtccggtcatggatagcatggtatgtgtcagctagcaaggtaggaaccggattcctggaatggaagatctcaatagcattcatgtccacaaagttgtcgagattcgggaagagaatgagcccatagataagcaatgcaagaatagcctcgagtgtgtcctgacaagtagtttcgagattagcttgctcaagtagatactttgaaatgaaccctcagatgtgagacttagtagtaagatgcttggagacatcggaagtcttgagatagagatccttagcaataaccagaggagtaagagaagccccgagaccggtgaaaggcgtcttctcggctataggtgaacctaacaagtatgaataagcctcaagagtagggaccaactggaaatccgggaaagtgaagcaacggaaactcgggtcataaaattgcactagagtgtgcacgagcttctcttcaacattagtccggagaatagtaagcaaaccaccataccggagtcggaaacctgtttgattcttcaccttgagtgccaactctctcaaactaaccaaatcaacctccttgaacttgtaggatttagtcttcttcatacctgtaatgtttacaaagctttttaatttgtccaatccttcgatgaatgcatgagaaaaaatttatgcatgaatgcatgtatgcatgattgtttttttcaattacagagaaaacatggagggttgagattaaagtcgaggagccaagggcggacacggtgcccggtaaactaaagtttaggataatagtaaccaaggttctaatcaagttcccaaactgcaacctctctttcgtatatcatggtagcacgggacaacgtccgttccatgtttattcgaaagaaggtctagtttgagtgtagtatcgcgtgacgactaaaactcgagacaacactcggtttagccaccgcactacgtcctaaaaaggccagggatgggtttggtaactacggtccatagcatcgtcgaacaattgaaagcaaagtgcctaagcatgacaacacacgccgacaatattacttccaaaatgcctcagctatgtgagattgatcgcataacccaatacacgaggcaaccctcggatcgaattgtcgattatatctctacctattcataagttcactcagcccgggtataggacttttgatattctcaccccacacgtcaaatgaaaaataaacaagtattcacatatgtaagcaataaaacaaagcgtgaatataaactaaggaaaactaggcgtgacccgctaaaaaaaagtccccagtgaagtcgccatttctgttatcacgattttcgggtgtcaagtcattaattaggcttgaacccttcaatctttgatattctctattttttcttgggaagggcaaaattgagaaaaaacccttagattctaagttcgggggtcgttttcactacgggaaggtgttaggcacccgcggtgactatagtactctataggagccgttttcttagtttatgtctacactttattttttaatgctatttatgaaaaaggaaatttatttatgttaagaatggggggagaaagtgtttgaggttttattttagtggacttggagaggttttgacctcatgcctacatacccatttaagggatcaaactccatgtagttctctctcaaaaaatgttttttgtgtgtttggttgattttaatttttgttggaaaatggttttgaagaaaagaaagaggccttaaaggcataagagaagaaaatggtgaatggttggttcaattgttattaaaaaaagtctaagtagggattaggattcatttggatttgtttaagaaaataaaggaagaaattcaatggagttttgactccaaggtttgtttggaaaaatttgagtgatggaattggtttattatttttgaaaattgacatttgtctaaaaatcgcgtttcctaagcatacatctaaacggtaatcatgcaacgtgtgtgcgtgtcggtgcttgtgtcggtgtacatcacttatagtgtccatagtcctttacatcgagtcctagatacatgctatggtcttgcaagaatgtaaactaaactaaactaactaaatttattacaaaccagttggcatagaaatgaatacaaaaagaaaacctaaattaggagcaatgagggtacaaagattaggtgcttatggaacgaatgagatatgaagcataagagttagtaacacaagtacaaaatgataataataaaaaaaaagatgcaagcaatatagaattgaatagcacaagagaaagaaaataatgcaacgaaacaaagtagtaaaaataatgcaagcaatgttgaattgaatagcacaagagaaagaaaataatgcaatgaaacaaagtagtaaaaatacacctagaatttaggtataacactcatacatgcatatgacctataattccctcattatagccatttttgaaaggtttgaatttaagctacaatgtgaggatgataagagtacacacaagcaaagcattatatcatattcctagagatattttcacacattatttcacatgcaaaaatatcataatatgtaaaaaatgcatcaagaacatatatggaatttaatgagcaagaattaaaagaacaaagtaaagaaaataaatgcaaaaataagcaaataaattctaacacttagaggaaaaattaaaatgatagggaaatatttttagaaattttttagaagcataaaacaccaagaaagtgtaaaaaagtagttaaaacacaattaaaaagcaattaaaaagaggctcaacaggatttaatctggtccgctggatgaatccagaggtccagatctaactcccaagatcacatcacagccactggatcaaagatccaagggtccaaaaaaaagcacaaaagatagtgtaaaatgcaggaagcacagtgaccgttagatcaaagatctaacggttcaaatagaagatataacatattccacacaaaaaatcacacacaggattcaaaatcaaaaacacagcagccatcagatcttggaacaatccagatctgatggttcacagagcgaaggaacaccacagaaacatgcacgcgcgcgtgggaacgaagggagtatataaaggaattttcacacaaaaaactcacaaaaacaaatctccttctctctctaagtcccacttagagagagaagctctcccctctctctaagaagctgaccggagaaggtggaggaggaagctccggcgcggcggccggccggtttccggcagcggcaccaccgtgcccgaaaaatcaaactactttttttttcaaaatttttataccaaaagcttcgtctcctcctcctctacacaaatccggcactagttttagaaagggctgagagatttgggctagatctacacttgaacttcgaaaaaatttcacactttttttgaaaaataactacggatctagatatccttttctttatagagtccgaatccggtctcggaatttctaaaatccgaacgtacaagcctagatctacaaatacatatccgtaacaaactttttcacactttttctacactatatgcgcgcgcgaaaatgaagaaaaagaggagagaaatgcgttacctctgtcgtagaacggagaaaaatcttcggaaaacttcgaatctcccttttccccctccgtgcgcgcgcgtttcaactccgtttgtggttgtttttgctcaaaaatccggtacgttttggtgttgatgtgatgattcgcggtggttttgagtgaatctggttcggatttgttgattttgtggtgattggagttgattctgagcagatccggtttagatctgttgattttggtgatgatgtgttcttggtgttcttcctcttttttctgagattttttctgttttgattctgttatggatgagagagagaaaaagattctgtttgagactgattgtgattgattctgatttttttttctgactgattgtgatggatctgacacatttactatttatagcctgccatgtgtatctgagaaccaatgaaaaaatgacatctgttttgggactgatgtggatcgaaaatctggactaaaatgcccctgggacctttctgcaaaataaaaaacttgaaggactggactgcaataaaagatggactaaaatgaaatttttaaaagttttggacccaaaacgtgattaaaaataaaattggactaaaaagtaaatttgacgaaacgtaaagcgaaaccaaaaataaaatcaacaaaaggactaaaacaaaccaattactgacatgaggtattttaaaatacctccctgtcgaaattttgacaggaaaagaccaaaatgccccccagggactaaactgatccaaactgactcaaatacaatttttgaaatgatttttaaacaaagactcaacaatgatttgtacagaaaaattgaaaagactcagaggcaaacacagcgacaaaaatgggttccactgcaggaaatgaccaaaatacccttttgtatgatttttttgaaataaaatgcaagaaaagtaatgcgacgtttcagagagttcttaaatgacttgtaatgtcagaaaagacagaggcagtaaaatacgtttaaaaagagagtaaagattcagagtaaaataacagagaattgacaaatatcagtgttagaaaagaaatttgaacgagtatttttaggtccaaaatcagggtacaacagctgcccctatttaagtttctttgttcggagggtcaagagacggagtctttggcttgacgggacgaagatacttaaatattaacatttgcactgtgtttggacgtaaaaatacgcttgtacattttcaaacatcatgaatgccatgcaacatttggattatgaatgcgagacaaacgagagttggaactaacaaaagatgtcgtatccattgcgggattggtagacattggtaagttaacagataacagggtagataggagactaggaacaaattgacgggtacaagctgctcttggattgagctgggcacttgacctggaataaaagcggacaaacaggtgcgagttgttcttggattcgaactggtcactcgaccggggacatagaaaaggtagacaggtacgagttgttcttgattcgaactggtcactcgactgaaagcaaaggaaaatagacaggtgcgagcttgttctcggatgcgaactggttactccaccggagacaaagacaaaatagacaggcgcaagctgctcttggatcgagctagccacttgagcgaacagaaacagatagacgggtacaagctgttcttggacttgaactagccacttgaccaaaatcatagacacatagacaggtacgagctgttcttggattcgaactggtaactcgaccgataacattgaaaagtaaacgggtgcaagctgctcttggattgagctgggcactcgaccgataacataagcaaattgataggtacaagctgttcttggacttgaactagccacttgaccgaacagagacaaattcacaggggattagttttttgacaaaatataggttgaaattgacttgacgtcgatttgatttgaaaggtagaaattgaccaatattattggctcacaaggttttgacagagaacctgacatgagtattgaattgagactgatgttgacattggaaatgcaatatgcatggatgatataacagtttcattaaatgcatgggcacgtaatatgcatgattatgcatgtatgaatgcttgtaatgcatgactgttggcagctggtagacacagtttcgcagagacagacaagacattggagtattgggcacgtagtggctcgtgctatattacacattcttggaaatcctctttggagatgaagtcgttgggagacgtatcggaaccatggctgagggcaggtagctatgcaacttgctggggatagaatctcggaagactctactgggaataatgtcggatgtatcgtggatgtcgcatctgtggtcaatgctttttgcatgttattttctcaaattttcattcatcattttttttgcatcccatttttgcctggatcgccctttcgggttttcgatccaccgggaaaataaattcttttcaatgccccatttttgcctgaactgccctttcgggttgtcaatccagcggggtgctcatttttgcctaagccgcccttccgggttttcaacttagcgagcctattcattttcatgcattttcattctgttttttcattcttgccattgaccacagactatcctggaggagaacctgcttgtaacatatattgaaatagacaccaacatacactcgctcatgcatgtttcgtttgaatgtaccctgttgctcaggtttgcttttcaaaaaactttttcaattttcaagatgcttgtttcgagcatttgtcattattaaaaatagaaggaaaatgttttttgaacataactttgaaagtaaaaagaaattagagtttcaaacaaaagcacaggctcaatttgatgtataagggtggtggtcagccgaaggcgtgactccacggatttacaaagcttggaaaatggggtaccgagctcagacttttaattctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtataaaccaatcctgaaaactctcagtggttgtatccaatcgcctttttatgtcgggcctcaacccgttctggatcttgatgcatctcgagaactcagcattctcaccagtatagtgcggatagaacttcgacagctccacgaactgggcagcatactctgtcacagacatgtttccttgcttcaactcaaggaactcgatctccttcttcccgcgaacatcttccggaaagtatcttctcaggaactctctcctgaacacagcccaagtcacaacagctccctcctgcccaagggtaggcagaagagcaacccaccagtcatcagctgcctcggctagctgatgagtaccaaaccgcaccttctgttcttcagtgcactgcataactcggaaaatcctctcaatctccttaagccacgtctgggctccatcagggtcataacgtcctttgaaagtcggagggttcttcttcatgaacgtctccaacatcctagcttcagcgttcgcaccagcatttgcgttaggttgttgtcccacagcttgggcaacagcttgtagagcagcagctaacgcagcatcgtttcttccagccatttccgagattctacaaaagtagcaacaacaacataagatagtaatataaatattactaagactcgacacgactcttctaattgaccggacggatcgacctactctgataccaattgtaacaccccgttttcctaacataaaaattcttaaaaacatttatcagagtaagcatcataaacaacgggatatcacataaaacataatccaaaacagttaaataataatttaaccaatatcttaaacattgcagcggaaaatcataatcataattcataaaacgttttggcacgcaggccccatcaaaagttgataatcacaatccataacattataaaaataacatattagtcacgtaagagaatgaagcatgcataaacataaaccccatcccgttacgtatcagagcgacctagacgacacagtgaggcaaggccactcacagaagcaactgcacactaagcacgatcacctgcaagttacccatacgaagggcaacattttcaagcagaaggggtgagatttcataacaaaataatgctaatcaaagtaattcgaatcataattaacattaacatcataatcattcttggatagcttcgcatattcaaataacaagtatcacgtattcatatattcaataaacaaatatcacgtattcacttattcaatcgtcatcaacaacatagcattatggacatgactatgtgacaatgctcttagactccttatatgcatgtggtaccaatcgtcatcatgagtattaatatactttaatcgtgcggaggacaaagctcctaataatcgtgcggaggacaaagctcctaataaacgtggtgaggactaagctcaatgagatgctatgcatggactcttatgaacaaaacatcgtaatcaacatatcaacatgcatccaacaatttggagctaaacgtcatcatttcatcatgtataaatatatacaatgcacttagttaaataacagcagcagcataatcaagtcacataacaggatgatatcattatatcaatagcacatcaattatttcataattcaacttccatatcttacataaatatacaataccttaatcatactcaatcaatatcaacatatcttaaacagcttacagactgcatttaacatcatcattaggtcttattatcataagggggttcgctcttgatcaaaacgtgcgatacaaatcgcataaacactcataacactcaaggctggaggtgctcgcgaggcgagggttcttgctcgccatggcgactactaaacaattcccaaactcaagttgttctgggtctaatcttgccctacattcattcctaatcattactaggtatgttcaggcacactaaggcattcaaggtccaactaaaaagtcgaaaatacaaaatctaacatgctctctgccttagctcgctatggcgagtaaggtcgctcgctatggcgagctgcattgcacaactcgcgaggcgaggaaacagggttcgcgaggcgagcgatgaatgttcatcactcgcgaggcgagattcatagctcgccgtggcgagcgatgaatgtcgctacggccagacttcctaaattcacaaaaactcgacgtttcacatggttctaagcttgtttttgattccaaagttcgtcctaaacattatctaaggtctaggaacactttctacatcaattaaaccaattctcaccgtttgatcatcaattctaaggttttgacctagttttcgttttctccaattcactcctaattcttgttaactaatcatcagaatcacattcaattaacaatactgagttattagtctcacccttacctggttatgaagaaatcgcagccctctctatgctcttctcccttctaagctttttctccctttttcaaaagttttcacgtacaatgagtttctaaaatattaggtcttccctatttatacctctttctaataacttatcttatctcactttctcccccaaaactatctaaaatatcaaaacagccctcaactaaatattttatattattttcaaatctttattttatttaacaataaaataattctcatatcataatcaaatcctccaaaactcataacttatcacgtcatcaatcaaatcactaaattcaccacaaatcatcaaaacacatcaaaatcatgcatatactatataattataatataattgcctaaactcgattaaataacgattaaacgaaagtgggcgttacaataccaattgtaacaccccgttttcccaatatacaaatttcataaacaattatcagagtaaaaaccataaacgggatatcacatagaaacgtaatccaaaaacagttaaataataatttaaccttcacaaatatctttaacatagcagcggaatattaattcgaaagtcataaattagtttggcacgtaggccccatcaaaatagttgattatccataacataataagaataacatattatccacgtaaaagaatgaagcatgtataacattaaaccccatcccgttacgtatcagagcgacctagacgacacagtgaaggcaaggccactcacgacggcagctgcacactaagcacgatcacctgcaagttacccatacgaagggcaacattttcaagcagaaggggtgagatttcataacaaaataacattaatcaatgtaattgcgaatcataattaacatcttaatcattcctttatcaactttgcataaatgctaaacagttgtcacgtaatcatatatccaatcattatcaacaacataacataatcattaaacacttatcacgtaatcacatattcaatcattatcaacaaggcatcttaatcatgacaatgtgacaatgctcttagactccttatatgcatgtggtaccaatcgtcatcataagtattaatatactttaatcgtgcggaggacaaagctcctataaaacgtgcggaggacaaagctcctattaatcgtggtgaggactaagctcaatgagatgctatgcatggacacttatgaacagaacatcgtaatcaacatatcaacatgcatccaataatttggagctaaactttatcatatacttatgcacttagttaaataacgaaagcagcataaacaagtcacataacaagatgatatcattgtatccatagcacataaattgcatcattatcaaaccttcatatcttgcatgaatattcaataccttagtccatattcaattaatattaacataacctaaacaactctacagacttcgtttaacggcatcactaggtctcattaccagttatgggttcactgttgatcaacgcgtgcgacacagatcacacaaacactcaaacaagtacattctggttgtactcgcgaggcgagagtacttactcgccatggcgagtaccactccactcccaaactaatgttgttctgggttccctctgatcctacattcattcctaatcaatactaggtatgttcaggcactcaaaggcactcaaggtccaactaaaaaggtcgaaacacgaaatctaacatacactctgccttagctcgctatggcgagtaaggtggctcgcagtggcgagctgcatcacacaactcgcaaggcgaaggggattgctcgccatggcgagttgaactaaacaactcgcgaggcgaagggaagggctcgcgtggcgagcgatgaagttcatcactcgggaggcgaggatcatcactcgccgtggcgagcgatgaacagaagcacgggcagactagggtttttctcaaaaaaccatcacacaacatggttcaaagcctaattttgattccataatccaccctaaacaagttctaaggttaaaggacggtttctacatcaatctaaacaagttttaccgtttgatcatcaattttttgggttttgacctaattccaaaacttttctaaatcaatcctaactttgtcaattaatcatcagaattacaacgatcaacgttattgaattattagtctcacccttacctggttatgaagaaaatcgcagcactcttggtctcttgctcctctctaagcttttctccctttttccaaaagttttcacgtacaatgagtttctaaaatattaggtcttctcctatttatatctcttcctaattacttatcttatctcactttcacccccaaaactatctaaaatatcaaaacagccctcaactaaatattttatattattttcaaatctttattttatttaacaataaaataattctcatatcataatcaaatcctccaaaactcataacttatcacgtcatcaatcaaatcactaaattcaccacaaatcatcaaaacacatcaaaatcatgcatatactatataattataatataattggctaaactcgattaaataacgattaaacgaaagtgggcgttacagcaattccctgacacagatggtcaaatcctactatagggtaggcgcagaggaggcacaaaacgggagggaaaaagcgtgggtgtactgcaatttgcgaggggtttagcccctggcaggcctgcaacggaccagctttcccagtgccttgtcaagtcaatcgaaaaaaggctgacatgcgaggtgtttagcctctggcaggcctgcaacggaccagctttcccagtgccttgtcaagtcaaccggaaaaaggatgacattctttgaattttgcgcatccgaggggcgcatccttggcagaagccgttggttttctctgacacagcagagattccttcagcttttgaattttcaaactggcgcctaaacaaaagccacgccattttacaaaaaacgaggggcaaagtccctgtcttttatgccaacggttgtccttggcattttccctggcaaatttgccaggggtttcaaacccttgacaaaatccctggcaaaaggtcattattcttgcagtgtttgtagtctcttgctattttgagtagtgagcagttgtaatcagatattgattttagtgaaatctccttggaagtgcaagggggtcatgactacttccggtttgtggaagaaacctatataattgttgtgtctttcttctctatctctctctttacttattcgctgcatttggattctgaacatcacttcagaagttgaactctatcaggttgtgaacagcgatttcagttttaggagaagaaaaagaaaccacaattcaaccccccttcttgtgtttttctcaccttcaaattaaatcactcgttgcaccactgaaaggggaggctacatcgcaaaggcaaggatttggatctgtgagggatgaaaaggaaagtcggttactgtttgtttcaggagtgagaagagagcttgttttcaacaacataagttttgtgtttacatatcattcatttgtttttttagtccatccaagattattttttttgactacgttaacaacaaaaaaagtatcgcaactagtttttttttttttttacaaaggtagttaaaatatgattcatttatttttaaatcaactaataaaataatacacatagtattcatttaaccaaataaaaaacatttaaagcatacaaaataattgcaaattacaataaatatcaaagacttaagactaattatttaattttagtattatataaatttatagttatagcatatataatgttcgagatgagcactaaagtgcccgtacttgcactcgcacttgttcaaatttcgagtactcaagttcaggccaagacccaacaacatcgacatttagcctggccatcatgagtatattttgtggatgtccattagatttgagtccaattgtcatccatacgagttgtgtatgaagaaaaagtttttgaaaaattcttagatattttaagtttgaatcgataacaataagtataaggtcatactaacaaatacgtaatgacacatgttaagaatttaaaaaagaaaataactaataaattttatataaaaaaatgtttccttttatagttttaatatgataaaattctcttttttaaacccttaacaaatatttttacagctttattagcatttttcataaattatttacaatctttattactagtgtaattctttttttttttttttgacaaaattactagtgtaattctggagacttaagttttgcagttacgcgggtagtattattttttactcgttttatgccaaaattaaaaacgtttttcttatcttagtcgttaatcgttatattaagtgtcaaggtttgaccaaaaaaacaaagtgtcaaggtcaatcatagtgagaggttgaaatgcacaacacagatttagagagagaaaacttttaccaaacgaaatgaggataattgtgacatagaaaaatcatatagtacatgcataactcaaattttattagtttcaataaatcataagttaaaggcttaacttgatgtctctgtttaatgcttactccatttgtgaaattggtaaagatgcagctggaattgctggtactacattttcttcctcaaattttcagtgattttattacatttaacattttaaacttatctttatcttgatctcaattcttccttgtttatttgtaggtaatatctttgcatttgggttatttgtatctccaatgtaagtttcttaaagtattttttttattaaattaaaaattaagcttagaaattttttcatgtatgtattttgattattaattaattttgattatattgtgaattgtagacccacatttaggagaattatgagaaatgggtcaacagaattgttctcaggattgccatatatttattctctattaaactgtttgatctgtttgtggtatggtactcctcttatatcatgtgataatttgttggttaccactgttaattcaattggagcagcttttcagcttgtgtacattttcttattcttaatctatgctgagaaaccaaaaaaggttatttttctaatactatatatggaaagtttatgataaatttcgtcacatggattttgaagtgttactaagatgtgttattattgtatacttctttttgataggtgagaatgtttggattattgctggcagttttaggtatatttgtgatcatactagtcgggagcttgaaaataaccgatagttctattcgccgaattttagttggatgcttgagttgtgcttctctcatttcaatgtttgcctctccgttgtttataattgtaagtttaacattttcctagatatccatgtaatactgagttttactagtttgtgtgaattcaagcttggtgaacttgtttatatcaatataatttcgcagaaattggtcattcgcacgaagagtgttgagtttatgccgttttatctttcgttttcgaccttcttaatgagcatctccttctttctttatggattactcagtgacgatgccttcatttatgtaagagtcttttcatctcatttctttctgaaatattgataacagttttagaattcagatgtttattctgttggcttatatttgtatacctacattttgtgtttgatttgttaggtaccaaatgggataggtactgttttgggaatgatacagttgattttatacttctattacaagcgttcatctagcgatgactctacagaacccttgatagtatcgtatggataatctatgctgacaaaggtaaaggcaaacgaacacacagtttgtgattatgatttattagtcttccacagtctgtgttaggcgattttctgaaattagtctcaaacattcattatgtatgaaaatattagcaatcaatgagacaatgatgttaatatccaccttgtgatattaaaagctaaggccataattgtaaaccgttcaaaaatcttgaacttttttctttatgtatttaatttcttctgtaccagtatagtgaataatatgttcgctgataggctcattaagaggaaaaaagtgaggtgttatgaggagcatgaaagagttctgtttagtggtttaaggcccatttagatttcatccatcttataaggatctagtgtccaaccattttcaaagttctttcattgattttctaaggttattgtaacagaggtatatttctccaagatagccaaaattcattatcagtgttattcacttgagaccttgaggaggagcgcacactccaatgtgtgatgtcttgattagtagggttatccattcctcgattaaactatgctagatggaaagtttagctctttctcattctgtatttgtgggatataggtcggtatttagcagccttacaaagagaacacctaaatgctatacttaattgattgaaaaaatgttgatgcatattacatgtgacgtgatcatgaataatgctgtaaacatgttgtcaaatataaatttagagtgaaagagaagcatcgttacataatagtattaagatttaaatatttcatccaagtaaaatttccttctaaatgaagtattgatttgaccaaaaaactacatgaatattctcctgtgatgacatgttagttgaattgaatatcattctgtgtctgtttccaaattgtccagttgacattggactatctccattttgtgcttagaagctgtattttgaggagtgaaagagaagcattgttgcagaatagtgttaagatttaaatattccattaaaataggttatccttctaaatgaagtcttgatttgacaaaaaaaatatgaaaattgtcctttatggtgagatgttagttgaattgaatatctttttgcgtctgttaccatattttccagatggcatagaactatcttcacttttgcttatacactgtatttacaaatgagtcatttgaaaatactacagaaagtgtaagaaggttatcggtgtgtttttgctttggaaaaatatatattatgagagtgatatgataattacctttgcaaagaaaaaagtgtgatatgataatttcattacagtaaaacctcattgtctatctgatacaacttagagcagaaagaaagacagtgtaacataagtactatagtaaatcttttagtgtagtcctcactgtaacatctctttcttcctgcacaaaagaacgatctcaaagtcagacatagaaataatagatgctgtaaatatgttgtctgaaactagaggtagcaacattgttttgattcaatattttggaacaattaatgttgcattctatagagtgataagttattattgagtatagctcataggctcagaagaggggcgatggatctgagctagcgtagagaagcgaccttcaccctaatcattcaagtacggtttagggtattgttgtaacctggaccgtattatacacacacacacacacacacatatatatatatatatagtttgtgacactgtaaaccctaatcattcaagtaataatacagctactctgtaattgcaaatataggcacacttgtcaaattgcgtaaacaaatgatcgtgttccattgtctgcaattttgtttctttcttttactagttgttgttccaacagttactagtacctcagaatttttgtgtctttctagataatcatctctgggttttcaactatattaaattttctttggtagtatagacacagcccttctctcatgtcatgttgcctttattttgattaaaaaaaggtgttagaaattaaaatttgtggtgtttaaacgcaggtccctttatatgtagaccctgtcaaagacctgctgcattccagttttaaattttcttaataataatttcaaaacaaatttgcaccaaaccctgcgtatgcggaagctttgtggatcgggcagccctttttagtttcaaaacaaattttctcaatctctttaaaaaataatttcagggaagaacaaaattagatgcattgattaattatgtgagtagttaattaattgagaaaatagtcattctgagtttcaatcatttgataaaatagtgatcttacgctcagtgacagaggtagtaatattatgaatgaagttcaaaagttttacatattaatgcattcatttgagtgttgcaatgtgctttaaagtggtactatttgaaagaaaagcatatcgcatcgttcgttatcgaggccaagttcagtagatttaacatgacatgcagctacaaacaagtaatttcagcaatttgatctcacaattgtcttacattaatagttatatcatgcactttacttatgaataagtacgccatcaaatggtatttgtaggaacaaatatacattatactatctacaataatggatttaatgaaggaaaaaattgattacctgttcagaaatttccatgcattgttgtatctcattcacagaatcattaagcaatcttcctttttcatcatagagaatgagtccactaaaacttggaagctcacatttctcccctctcaatattggtctttgccacactgctgatgctgaatcatgactaacacttttccacccattttcaaccccatgcctttgtaaacttccaagcaatggtgatcccctctctctctgccatctaatactctcttccaattttcttgccttgctccacaccattgaacccatcaacacccttttcactgaaatccatccacaatttggttctaaccattctgtagaagcagtagtagtactagagttagtaacattcgtcgtagtggtggtggtggtagtagtagtcgtcgtgatagtcgaactagactcattctcttctataacaccctcttggttcaaaaccttattattattattattactacctttcctttttagtacaataatagtgcaaagacaaacaagtgcaaaaaatgcacatgcaagtagaagaatagcacctagtgttgaaatcttcaatttgtctaccaaatcccataaagcttccatgagttgcttgctcttttcctattttagtgtaacaaagtgaacatggaaatgatgagcaaagagccttggtttgatttgattgaatatagttggtgatgtggaataatgaagtagtaaaaggaaataaaataaaaaataaaaaatttgcatgaaccatgtttgtttggttaggttggcaaggttcatatgaggtccaccgctaatatgaattgttgaaacttgggccccatttacgtttgtggggcatacatggaatcgtagccgttggtgttgaattaattgatggctcaccgttcaaagataaattaatggcttctcacgaggactatgttgttgctattaagtgatgatggaaaagcacagttgaaattttgggaatcggatgttgtctgttacactgttaaagggatgtaaacgtagaccagcgtacgacataatactccctccgtttttaaatataaataaaattaattttttaggttcatttatttaataatatatatggttcataatgtggaccacatacattattaaataaatagacctaaaaaatcaattttatttatatttaaaaatggaggaagtatatcatacgattgggaaaatgaggtaatgaagaagagagtaatatgagtacccttcaaaaaaaaagagagtaatatgagtaagttgctagggaccttaattgttgttgttcaatgcaccgtggggaccttccatactaatcagtaagcactctttcagtagtacttcctccattttctctgtgcttaattctaagactgttttttaaaaaaattgtccttaaaatttaagactatctataaatttttaggtgcaattattactttttttttcaactataccttattaatgccagtgtcttttccgtttttttaatgagtcaatgtttgaaaattatgaacgatgttttttttatgaaattttgatttacaaattgtatcatatggttgggaaaaagggcttaggatcatcttcttcagttcggccatcttgtggggttaccacgttcttctcattctttccttaggataatctggctagcttgtgtttgagttatctggaaggagcagaacaacagagtttttaatcgcaaattcttggattcacaaagtattgcacacaaggttaaaagacaatcttacctttagctaaaatttatgattaatggcgacaccctttactatgcatgggtgttttgatgtagtgttattattattattattatttttgttttcttctttgcggtgttccaatttttggcaccggtgacttgactttgttagtgctttggtgtttctctttgcatgtcttgttcgaaatgaaacaccttggttaatgttatatcccatttgggcttgataaaaaaaagagttatgatacataaacacccttaggtggcaatacaccccttgacacccacacaaaaatctgacatgtggccatatggaccccgcacaagtacactttctctttcttcttctcttctctcttcctaatacatggggtgtacaagtagggttgggaataggccaggccggcctataggggcctatggcctggcctgtttaagcctggcctggcctggcctgtttattaaaaaggctaggcttaggctttttaaaaagcctatttaagtaaataggccaggcttaggctatcaaaaaagcctatgaagcctaataggccggcctgtttatgcatgttaggctttatagtggactttttaaataggctttaaagcattatagtgaaataggcttttaaggccttatagtgatagacaagtcttacactcaaataggctttgaggcctattaaacctatttaaaagtagataaaatggaatgtttagtgaggcctattaaacctatttaaaagtaggcctgtaaataggctttcaggccaggccaggcttttaaataggccaggccaggccaaaaaaataggcctatgaaaggccataggccaggctcaggcctgcaaaaaattttgtaggccaggctcaggcctatcaaagcctggcctggcctggcctattcccaaccctatgtacaagggtgtatgcaattaaaaggtgtttatgtaacattttaataaatttatacttatctatttgttacatgtgttatttgtattcaaaattaagagcattttttgaaagagaaaaactcagccctaaaatgctgagagggagtgttttctttatatattggcttcttgaaacacattctgtccaactttttctaaataaatagctattgtcaaattttatcatttgttgctgctataagctaactttcatgtattgactaatttttggattattttgtttttagtctctacaatactagcaatttttaaattttaatccttaatttttttgttatatagattaaatccaagaccaaaaacatttttttttaaatttaaaaaaatcaaaacaatgaataattttttttaataactaaacctaaaagattataatttataggactaaaaacatatattatccttaaacttaacatgttggttttaaaactttgttttctttcaaaaaaaattattttattttttctttttagttggcccctgcgtaaattttttgttatcttcgcaggctccataacagtttggaactgtgaagccccgatacttcaaaatggatgacgtaccgtatcccctgagtatcctgcaccgatacctgcccgatacttcccgatacgtatccgaagagtatccaaatattaaattttattttttaaaaaaataattatccgatactttccgatacatcccgatacgcacggatacttgtgtttttttatattattttgatttctgttttttttttttgtgtaaaaaataagaataaaaaaattatattactataatatatatacatttcctttatctttctttggtgcccgtacgatccacaccacaccacacaaccaaattgtatctttccctttctcttaatcgtcaatattatatttatattaatgtgctacgagcctggtttcttgtgtttgttaatatacttgcatattaaaaaaatggttatattatataatacatttaattatataattttttttattaacgtatcccagccgtatcgtatcttgatttttgaaatttttccgtatcggcgtatcggtgcagtatcgtatccgtatcatatctcgtatccgggcttcacaggtttggaacgtatctcccaaatggtattaacagggtcaaaagtgaaatttcagggagcttgtgagatttggggatggggggctaaaaagtaatcttcttacaaatcaacaaacccatgtcgtcagcagatccgatctgccgcttgaattcaacaaaccgcgggttccaaaatccaaactcaaaacgccaacacttctactctcccgccttattatttttcacttaaaaaaatttcattttcatttttccaatttctccctcccagtttttcttttttcattttccattttccaattcattcccacgcattttcctctccctcccagtttcaattcaaattcccgcaaaaccaaaaaaactttcctttcttaatcaaaatcaaatccttaaattaataacaccaatccttcatcccaaaacctcattctcatatctcaaccctaaatcaaaaacaatccaaacatggatttcaccaaaaacatcaccgacctaccacccaacaaacgactaagattcatttatcagcagcaacaacaacaggaagaacaggatcttagtcattgttcactcttacccaccaaaaaacgcaaagaatctcgtaactcatcactttttcacaccccaccttcatcaccaacacccccaccatctacttattctctacccaccaaaaaaagaataaccgcccttcaaccccaccttcaccaccacaataacatcccaaacgatgctgttccgctcatcgatctcaacgtcgaatacagtccttctctcccatcagccaccccaatcgaaaaacaatctcaaaaacaggacattgaatttgaagtcgatgatgatgaaattttatgctgtgtgtgccatagcacagacgctaatgctgaggatccaatcgttttctgcgacggttgtaacttaatggtccatgcttcctgctatggtaaccctctggtgaaacagatcccagatggtgactggttttgcgatcagtgtcgttttaaaaacgacattgatactgacaccggtccaattcgttgctccctctgtcctacgaaagagggagcaatgaaacaaacaacagatggaaagtgggtccatctggtttgtgctttacttgtgcctgaagtgttttttgtggatccagaagggagagaagggattgattgttctaaaattccaaagaagaggtggttggagaagtgttatgtatgtgggtgctttgatggatgtgctttggtttgctctgaacagaagtgtggtttgggttttcatattacctgtggaatcaaagaggatctttgtattgagtataaggaagggaagaaaggtgctactgttgttgctggtttctgtaaaacccactctcagatctgggaaaaggtaacattttctttgatagatttagtttattttttaattaataattatattaattaacaattgtatagtagttttttcattattcattgagtttcttaagaatatttattttttggagtaagatctatatttttgatgactgaatcaattattattaataccatttattgtaattaaatatgataagctaaaaatgctgtcaatgactaaattttatctggttttaaagaattttattcatcaaaattattttataaactaattcaattattttgcaatagtgtagacatgagaattattgttagtgaattatttgaaggctaacttttctggcttggtagatttgtattttatgagtaagtttaatttaattttgttggtgcagaacaagggatctgggaaatacaaaattgttgcagttgaagataaagagtagcaagattggtagccgaggtcttttaattctgttaatcttcttagggaattccacagttggatactttaggagttcatttgagtttgttttagctttttttagtgtcgaatcttcttcggatgaagacagattacaacagtacttatcttacttttgattttggtggaaacagcatttagtttacctgagattggaatggaacaataacatttgaatgcatacaatagtttataaatttacggtgtagcattatgcatacttgtcaattggttttattgaagtttgatggctgcaaatgtgaaaatcatgctcattctagtggttaaaatgtcgattaattgctctgtggactaattgtgatcgcttgatcactgcaacacgtttatctatgcctctgcatttcttcgcctaaccgggtagggaactcaatactagtatgagtttcttcaaattgttttggatttaaatttatatgaacccctcttaaatgtaccatgattaatggatgcattcaatcttgttgaaaatctcaacgatattatcatgctcacctagtacattatttttggcattggcttataggtttttcaaacattatttcattcatgttgaactcattttttagaggaaacatacctaaccattggttgatgagttatgacaagtacactcatctctgctataaaaaacaagaggctaaggatatggagattgttgttttcaaattcattctttaaatgagtgctttaaaggttctgagattctatcccttagccactatctgtgatccaggtacaggtagaagtcatagttttcaatcttgtaagccaaaaacataatattaagtcatggcttgtgaatttgtattaaagtaattatggagggattgataaccatcaattgaatttcgacacttaagtgagtgaaataatcatttaccagtgagagagaaggtcagtatgacttggcacatttggagttatgtggcatatacaacactgagttgtcatcatcaaagcttaagtgtatgatttaataatagatacactatgcattgaaacaaaataatatacaactagcttgtctacaaaccattcaaaataagggttatgacaccaccatcatcatgtattttttgaggtggttaaaacaccagcatcatgcatctttggttgcttgctttcttttaaaaacttcccacagataatactctgattgaaatcctacaaaatgggtaattcaaaattttgacacaattaacaaacaataaagtttaaatgaagaagtagaatatacgtaatgaaatgtaactcactcttatattggcttgggagtatcgttgaaggaaaaattaaaagctaagatttttcaacagagctatatgttcacagggactaggcgagaatgagacagctgacacctagtccgcagcgaattagatatgtgtacttttggattattttggtttctgatttcaattttcatgagaaaaggtttcaaaggactataattgatggtactaatcttgtacattgtgatatattttcttatgttattatgttcgactgttagtataatagttttaggcttaaatatgtatttcatccttgcaattaggggtcgtttaaaaattggttcctatattcgctaatcattaattatttaaaatttcgtgctttgatcaacttaatcactaccacacatgaaattccaattttgcacttaagaagaggacacaatattgaagaaagaattggaaacccagggtaaaattggaatttcatgtgtgacagtgattgccacgtcatcaaattagtgacgtggcagtgattaagtggggagagggacgaaattttaaatgattaaacaatgcaagggtaaattgccaggattagcaattacatgaaccaatttttaaatgacccctaattgcaaggatgaaatacatatttaagccaataattttattatttggttattcttgcatttcagtttttgaattatttagctgctgaacctgccaactgcaagtattaagccttatcctatacattatacaacatatcaagatcatattccaacttcattagcaattacttagcaatctggacttattgaacacaaaagaggaagagagagagagagaatagagacggtatataaaaaataattgttgacatcaatgtgactctgcagactgaaaataagaccagtattccttgacaagtttcctgaacaacgattcttctctcttcatcaagttcgttggctcgtcatactccactagttttcctgaaagtacagtcacagaatttcatttatttgaagaaatcaagcaagtgattaaacatattctaacttttcttttatatgatttaaagtttgaaaatcaagtaccactcattttacatgttatcatttatgtgctatacaagatattgttttcacttcgcactcttaccttgtccacacatatataccaacagaaaattatttatcatcaacgagaaaaatgtttatgaggttatggattagtctgaaaagtgcttgttaataaaataaaataaaaggactataaaatagaaaaggggaaaaaaaagaaaaaacacttaccatcattgattgaaagaaccatagtgcaatccatcacagttggaattctgtgcgctactgtgattactgtacaatctgcaaactcggttctaatggttttcagcagaatataatcagttgaattatcgactgatgcagttgcttcatcaagtaccaatattctacttctccttaaaagcgcacgccccaaacagaataattgcctttgtcccatgctccaatttgatccatcctcaacaactgcgaaaaagaaattcactaatcattgccaactactctttctagtcctatttttatgaaacaaaagttgaaatcaccaacaccaaaaaaatacattcaaaagcattaatgctaaataagttttctaaaaatatcctaacattcatcaaataaaacttactgtcatggcgaagatgaattttctataattaatacacttcaaaagtatgacaattaaacatgaaagcgtacctgaggagtttaagccctcgtctttctcttggacaacttctcgcaattgacactttccaagaaccttcatattgtataagaattattccacatttcatatcgaattttttttaaataggtcatagtatatcttacctcccatatctcttggtcactgtattgagataaaggatccaagttatatctgactgtcccggtaaaaagcgtaggatcttgaggtataatgccaaaacgcgacctcaaatcatgaaggccaatagatgagatgtcaacgccatcaattataatgtttcctcctgatggttccacaagacgaaataaagcactaataagagtggattttccgctgcctgttcttccgacaataccaatcttgtgacctacttcgaatgtgcatgtgatcccatgaagtacaagtggtccgtcaggcctgtatcgtatctaacatagtaaaaataaacaaattattttgttaatatgagcttcattttttcttcacattatgcttcgcattttgaaaataagtaacaattaccttcaagtcatttatttctactttgcctgcaattggccaattcaaaggagggcgatttccttctacgatttctttggcctcactttgtatatgcatatattgatttagcctctcgactgatattatttgatttgcaagagtgcactgactttgaattgaattcactaagaaagaatttagtgcaagaccataagatagagccatgccaataaaacctggaatggagaattgatgctatttctttaggagagatgaaaataatacagaaacagtgacatttcagaggttagaataaccaaattctcaccagaggtgaaagtccctggtggaagtataaccatgcaaagtgctgcagaggcaagaacacctgcacttattgtttctaaccgttggatcaaccactcgtttgaggcaaaattatgaaaaaatgaactagcattaatgtcaattagatcaagattcttctgaaagaaacgatcttcctcctcaaaagttcttattgtcactgctccagaaacagtttcagctacatgatttgctacataggattttgttgtgccagttatccgcatcacttcttttgctgaggcaaagtagtatctctgcttaaaacacaaaataaaaaatgttttatcactatttgctttttgttgaagttataatgaagtatgtagaagaatatgaggaaatacgaatatgatacaaaagaccaagcactgaccactatacgaatttgttacatgataaatattaaaatatgttaccaaagatctgaaagcagaatactttttaaaactaagaatgagagttatatacctacgctatatgcaaagatgaacaagttaactattacctgcaagcgaatcgtaatataaaccattggtatagcgacaatcaatacttgccaagtgacaactgagaaaactgtaagagtagaataaaaattcatagtggttccgaccgcaaaagtgaggctaaatgggatatcaagatccataatgctcagttcagatgaaacctaaacaaggaaagaacaattacattattactttttctattgcatttcatagaaaaggagatgatcgtttaatatgcttaccctacttagtatccttcccaatggtgtacagtcataaaaaggcatcggtgcacgaaaaagggagttcatcaactgtaaaaataaatattttgaggattgaagacctaaagcaattacaaatagacttctagtcaacatgaaaaatgccgaagaagctccaagtaggaagtaaacaaaaatcaactggaacgtgctgacacgaggattgtctacatttgctgccatccacaagttttgcaatatctggcataccaaaaaaataaagtgaccaagtgaagccacaaagaagaatatatagcctttcatctgattcagatattgtaagtaaggcttcaaccctttgtctcctttctctctttcttcttgcttaattaattgattaccatttgcttctttacccttattttctactaaagtctgtgtaatctttatagaagctcgagaaaaagtaacatttacaagctggtttgaaccatcagtaaccttgtgagcattgacaaggtcttggaattctttgcttgtggccaatagctgctgatatggaccttcttgttggattaccccctctgacatcaactgtacataaaatttaatatttgaacaaccttaggcaaatcaatataagagctgctgtggtcaaatatcaacttctatggtctaaacaaacacttttaatttgagtttaagaaaattgttattacagaaagtgtgaaaataaaagaaacgtaaaatggaggttataaaatactacaagactcatattcatagttccttaagtccttcatacaaaataaaattgttggatatgatataggagcaataatgtgataagaatccaacagatgtcctgtcatgagtttagctcagttggtggtatgaaaaatgcataaaatatacaaggtttggggttcaaaccctgtccactaaaaaaataaaaattcatgccccgatgataaaggaaagaaaagtaaaataaaaaatttgtatagggtcgttaccacttaatcctatatataaagtcaaatgaacacttgcacaagcacactattacaatcacaatcttaaatctcaaatgtcttcaattttcaagcttctctcactcactgtattccttgcactcgttttccaaggtaagtaatatactacctttcatctctaacatgcatatgatggtaattttcacaagccatttataccctcaaagattatacaatagcaaaatgcttattattgtttttgatagaaattatttttaacttcaaatgtttaatacattgttcatatatatattgcagcttatgggatgtgcactttgagtgacattagcattaagcattacgaaacacatgactttgcacatggcatgccagtgtggagagttagcataaccaacaattgtggctgtcctcaatcacaagtgaagcttaattgcactggatttcaatcatatattggaattgatcaagcactcttggctgtttctgatactgagtgtcttgtcaaacaaggagcacctattcctgctgctcaatctgtcttttttcgctatgcgtggcttccaaagtttaaatttgaacctatttcttccaaaattggatgtacttaattaggattagttagggcaaaaatataatatattgtaacttattaggattgaataagaaaagctttgaagcttggattaccaatgtgcaaactggcaacatatatgacaaatcaaatctacccatatatcttaatttgagttttggttcactattttcaccattttgcagaactaatttatttatttatttatttttacaaactattcatttattttataaataatagttttgagttttccatcacatatttgatctacaatatagtttttaagatgacttttttacaatttcatcttgattgttttttactactctctccgttcatttttaagtgtctttttagagtgaatttttcgttcctatttaactgtcttttttgtattttaaaggtacgatttgtcaattacttttagctttttcaataaaactaattaatgctatctatttggaaaactaaagtttggttttttttaaacaaagtttattttttgttatcttcaaatttaaacaaaattttgttccaaacaatagttccaaaaagagttaaaattctataaataagaagagtagcaatcgttaaaaatttcaagtgtgacactagcattggttgaaaccatagttgaaaccttaactttgattaaaggagttggaagaaagttaattttttcttaacttttgattaatgtgaagttggaataacttttatattgacttaaaataatctatataatataaattgggtcctgctaaccggtgcccccggggcattggttaagcataccataaaagagaattattagcataaaaggaaactgtttttgactttattatcaattaattacattatttcaatgcattaactattatataattttctttttcacatccttaaccagtgccccgggggcaccggttagcatttcccatataaatttaggacctatttcaagtcctaatatggaagtaattttctcttctcttggtgttgacatgtggcatcataaaccaaaccaaacatttgtttttttaaagtgacatgtggcatcataaatcaaaccaaacattttcgtgcatttgacaattaatgaaaaaaggaatactaaagaaatattggattaatgaaatgaactaattattatttttattatctttattggattataggtctcaacaaacctatcctcctcatgcatttggttttcaatactcttccatattaatatttgtaaccatatatatcatttacattataatgaatgcaatattaatattttctatacaaaatattattgtgacattgaccaattgctaccctatcaaattgattttttttggccaattcacattgtaatgaatttataaactaaacaaatgaactaacttttatttttattttcatgatgataatatattaataatattgtgagacaattttattatcgtatattttataattgatagtaaagaatgaaattttaatgacattgttttacatgatatcatatttcaattataatatttttaaatatacagaaaaattgtatatattcttaacctattaaaaagattatcaaatttataatttatcacaaagtataaaatctaaaaaactaaatagtaataaaacaaatattattcacatttttatttcgttaaactcttcttccttttttaaagaaatttcattaaactattcaatttttattttaggatagaaaaagaaaaacggaagtacattgaatatgcattaataaaattattacttttaatcaaattgaatcaaagaaaataacactgaaatctcacttttaagtacattgaatatgcattaatattacttttaatttggtcaattttatatttgttcatatgttacttttttttttttttacaagaagcgttacttattttataagaggaagtgttacttaatcacaacaaatattatatggagaatgcattaaaaattaaaaatgtagtccaaatttttttttggtgcattaaatgttttcaaaaaatatgtttcacccaaattaataaacacgtctaatccagaagtcctaactcaactggtaaaatgctgaaattgttaggccggatactatgaccggggttcgaaccccggtacctccatttgtgtgtgtgagtttataatgactttgccatttcgtctatctaccaaaaaaaaaaacgcgtctaaaattaataaaatgattcaccaaaataaatgtatcatatcctttatatctaatggttgcaaacatgcaaaccctaattgtcaacctctaaccctacttttttggctccattttatcctgaccgttagatcattgtaattaggaagattagcacatcagctcttagatcattttatccaacctattttttggctcctaaatttgaaatttgaatttcacattgcaaaaccatgacaattattatgcacactactcaatacatatcttaagggctaggattaaaaagttatgcaaaaggctgaaaaaccaaacacaacacaccgtttcctctttcccaaaacaagctcacgttttcttcttcttcctcttatcatcatcaccaccgccaaccctctcccccattcatcggcggcaaccaccaaacctctgcctcaatccatcgacgttctccccattccctactccttcgttttgtccctcacctccagaaatataatgccatctcttcacattcaatctaacttatgattctcccttcttcaactccactggtgctgaacatgacggccatatccatgcctctcagttgtgacggttatagcaagggaacctaatatgatacacagggttactgttctccaatgaacgaggtgattacagagcttttgtattattctctacttcagaaataatttggtgacgatttgttttcatatttgtctttctccacaaatctatttcatatatgttcacgttccatttttttttgtttcaaccatggaaaattctcatgagaacaaacaaaaaccaccgaatgtgaaagataagctaaaaagggtaaacacgaattactctttgtgagtaagtttctcttcttaattctgtccagcagctgtttgatatattgtctctatgaactttcacctataatttggtttttcattcaatgttttaaaacccatttcaaattcacaatactccatatatcctttttagtttttaaattgtcgaactttgattttgaatttgtttctctttatcttttttttgttcgattgtagccatgactgataataacaaagttggttacacaattggttaacctttctcttctattttggtttaatttttttttgattgatattttgcacagaaggttatatctatgaagtgtaaggtttggagatgacatcgacgatttcttttgctttaaaatattttgaacggtttgacatgttcttcaaatgaattgttgttataaaagtcataatttataacattatataaccaatactctataaaaagctataatccatatattgctaaatgattgtagttgttgccatgccatgcccaatctcttgcttttgattaactgattttgttacatcatagattaaatgattctctactcatgatattgttgttcatgatcatagctttgacttagaagggcaatatatcagtagctgctctggtgatggaagcttagttcttcaaagacaaaaactatgtatattggaagtcttgcccaattgtctcctcttcacataacatgggtactctcccttctccttctattatttactcatactcacattcattcaaccaattattagattgtgcgtgtatattcttagaattgaaattgaaaatgaattgagagtacttttaaattgattgtctagaatagttatatgcatcatgttgagaccacaaaatttcaaaaaaaaaaaaaaaaaactgattcaattatgtgtttggctttggctgcttgagcatgggtttattttgaggtttttttctaattagttttttcctagacaaccctggctgtatcctcaacaattagttaaaatgttgaggggctgatggttttatgcacaaccacaatgtaatattgatattaaggtttccaataacatggtacttaattttaaaaagctacatagaaattatgaaaattaagatagtctcattttttttttaatgcgatttggattccaactatatttgaattattttatgcattttcttatacaatagttgtctctgatttttttaactatttttggctataattaatttaatgaaaacatgcattttgatctataaagattaaatagtagaggcaatatatgtgtggttaggttcttataaaatagttatctatgttatttttttgaactatttttggcaatatatgtgtggttccagttcacttatgagaagttgtctaatgatgaaattaaagctggtgtgatggtaattgcaggactgaagtcttatgtccatgtctttagtgtgtatattttcatatacttacaagttcatggtttttcaggaacttgcttataatggattttgtgagctaatccttgataggagaactactgctttgaagctggtggatgattgtgggaataagtgggattgcactctcatctttgatagtaggccatatcctcattttccagttggtggtggtttccaccggatgattcttgcaagaaggctcagagatggttgccatgtcatggttggtgcacctggtgttgggagcaatgacacactgtatttcagaattgttcgctactagggttttattttgtgttgtttaagaacagtctccatagaacttgctattatgtgcctgcttgctaattttaattattatgaactttgtgttttgctggagtgttgggataaaagcacctcttttatgaattattttatgtaatttccttattattaacttatccagtgttattgcttattattaatattccagttcagtttattataatatccagtataagtatacgcataccattattcatttttttgtcttatgaatgattgtgtaagtataacatcagtaacttctgtttgtgtttactgtaacacagcttttgaaatatcagaatttttatcatttggtgttgtttatactttagcaatgagatagtctcctatgtttgctttcaagatgattttggaccataatcatttcaatcatatgatattgatcatggttatacttgaaagtttccttgagcttatgatttgcagaactatttgacaatgcatactagccgatatgtgttttatgttaactacggtctacgtatatgagaagtatattccaccattccatgaaaattttattattccgctgaaaactcaaacagttttgacgaatcctaaatatgtatgttagtgtttggacaattatgaaaacatctttctaatctaactatgttgacacatatgctggtgtggtaattctcactccaagtatgaattaattggcagcataataatccaatcatgttgtcacaaaaaaaaattacttacgggtaaaagcttttttatactaaacaattattgtatgtacgtataacatgtgtttttataaaagtctggatgattcacccaaaaaaataaaagaccggattatatttcgcacctatagtttttaataaaaaaggtaggtaatgtttagaactatatatccgcacgggtgaaaagtctagtttcaataaaatgacatattaccaaattacccagtgaaatacgtctatatattagacattcgaatcagtctaatttcacaagacacacttctatcacattttttttctatttttcatttttgttttgatagagtagcaaatcaagaatcatgatcaaacacatcgcatttccacaaattcgctgatcgcaatcaaaagcagaggggttttcacataggagtgtcaatcatttataaaaattatgtaattgaatttctaccgtgtttgatagtccatttgtcatcttatttcagtttgtatttttctaaagacttaatgcatgagacttttacatgtaatcgaaattttgtagttatgtcttatgtttgtacaaaaaaaataatttatacatttaatggaaattttatagttattatgtttatacaaaggaaaaatgatttgtatttgtgaacaatcattctttctaattgacattccatcatttatgctctaatttttctttttcataattatgtgatctatatattcttataaagatcaaacgtcgacgtttgcaacaatatcaatattattttctctttttttattttttttatttttttattatgatgagattttacaattagttatataacatcaaagacctaagtatattcatttattttattctggataaaaacatttgatgatcaaatgaaatcttatttttcaaaaaaaaacaattgactaaagcataaaagtgattaccaaagattaaattattagtttcaatgagaatgaattattttcaaaaaagtatgatcacaagatgtaacaatttgactgcaattttttaagggaataaccaaattgtcatcaaattgagaaaagtgaggtgatggttttttttttttttttttttttgagatcatgttattaatattggtctcaaaattaaaaatagtattgaatcatcaaatagtattatacctctgaacaacttctgatctacctttgcgtctgcatcttcttcgcttaaggtgcaagttggatgcattggggtgttcatttcattacagtcatcaaccttgaacttcatcagaaggtccttagtgtatttggattgatgaacatatacttcatctttgcattggttgatttgaattctaagaaagaattttaattcacccatcatactcatttcaatctcatcctgcattaacttaaaaaattccttgcaaagagatgcattagtagaaccaaatattatatcatcaacataaatctgcacaattaagatggctttctcaagttttcttctaaaaagcgttgtgtcaacttgacctcttttaaaatcattttcaagtaagaaattacttagtctatcataccaagctctagggcttgttttagaccatatattgatttcttaaccttataaacataatcaggatgttttaaatcctcaaaacctggaggttgtttgacatacacttcttcagagatcgcaccattgagaaatgcactcttaaccttcatttgatataatataatgtcatgattaactgcataggatagatgtaacctgatttcttccaatcttgcaactagagcaaatgtttcagtatagtcaataccctcttgttgaatgtatccttgttcaataagtctagctttgtttctaacaacctctccttgttcattaagcttgttcctaaatacccattttgtttcaacagttttttttatttggtttagctaccagatcccatacatcatttatttggaattgattgagttcttcttgcatagctactattcatccatcatttgaaagtgtttcatcaacagaatatttttaagctttcctatcagccatgttggagtcaagtttatgccttcacccagaccacaccgagcttgtttcacggacagcttcgcaatagaattgaaacttccaaggtccttcttctttagaggtaatcgtccttgaaatattgccttgcagcttttggaaaatgcattcatgtcttttctcttcaacttacgcgaataagacacttgcattaagttagggagtcaaattactgcacgtaggtcacagtgaatttttatgaatttcagcacaactttgtccgaatttgaaatgaaatctggtattgataggtccagaattggtttaggtgtaaacacgaaagttgtaggtatggatgttagctttctaatgccgttggtttgacgtcaaaaagatttatagaacttgagttatggtcaaattacagcacgtaggtcacagtgaatgtttatgaatttcaatacaactttgtcagaatttgaaatgcaaactggtattgattggtacgtaattggtcttaggtgtaaacacgaaagttgtaggtatggatgttagctttccaacgccgttggtttgacttcaaaatgatttatagaacttgagttatggtcaaattacagcacgtatgccacaatgaatttttatgaatttcagcacaactttgtccgaatttgaaatgaaaactgatattgattgatacataattggtcttaggtgtaaacacgaaagttgtaggtattgatgttagatttctaatgccgttggtttgacttcaaaaggatttataaaacttgagttatagtcagattacagcaggtaggtcacagtgaataattgaatatgattgatgaattagtatatgtatgtgtatgtttgtgaatactatattgttcatgattgatgaagtgttatacgaatgtatatgtttatgagtatgatgttgtttatgattgatgaattagtatatgtatgtatatgttgcgaatacgatattgtccatgattgatgaaatgttatatgtatatatgatgtttaagttgatgttgattatcatttgaatttgatgttgttatatcttgagatgtttacgtgctgcctatgttgctgttgttggttatgtgaaatatttatatgcgttatgtggaaaatgtatgatgtttaagttgttgatactcttcattaatattgatgaatcgttgaagttgttgataaagacaaaccatggaatattgatgaatatgttgttgcttatgttattataagatggtgaatatgttgttccttatgttattataagatgctgaatatgttgtttcttatgttattataagatgatgaatatgttgttctttatatgattatgaaatgatgattatgttatgttgtttatattattatgagatgatgattatgctgtgttgtttatgttattatgagatgatgattatgttgtgtcgtttatgttataagatgatgtttatgatgtgatgatttatgatgttatatgatgatggttacaatttgattattatgtgctaagtgatgatgtatataatgcgatgaatatgaagttaataataattagaagttggttgagttattaagaatcattacataaatgattattattactaatatatgaagttatttatgttgttaaatataattaatgaattatatgcttgatattattgttttgtgaaatctcaccccttctgcttggaaatgttgctcttcgtatgagtaacttgcaggtgatcgagtttaagttgttgttagattgctgccgtgagtggattatctctcatgtgtgtctttaggtgctctgatacgtaacgggatgagaactttgttgcatgattttctattccttacgtattgcttatgaatttacatgattaagttgttaattggatttttatgagatactttgatgaggccttcgtgccaaaattattttagatgtttgaataaattctgctgcgaagtattaaatattatgttattgaattttgaaagataattaattaattattccgtttataattttaagaaaagaagtgtgacattccgtttatgtgaattactctgattaaataaatgaaatttttacgttggaaaaacggggtgttacagattgcactcctagtgcttcttccttcttcagataagtttccgacaagtgataacattgttctcctttcttgattttaggtcgaatgtatccaacaatcttttggactacaatttcaggcgaggatttgttcggggtattttcctttttatcttactcctgtcctattgtccaagtaaaaagatgaatatgatgtagagggactgagtgtgcattttgagagactgttagctcgttttcattgagtccgcttgacttgacacttaaagtggttgttctgctcaaaatattctacgatgttaatacgaagttcagaaatctctttatttaaacaatccatattctcaaagtccctattacttcttctcctaatagcatctattaaatcctcaatactttcattgagtgcagcgtatgccatagtcatcgcttttgtcattaaattgtatcgagcttgttcgtactcccataagtcagaagcagacatctgatacttcttgggatagattatgttgtaatgattgaactggtttgcaaaagaactatccattattcgttctctgaaataatcacaaacaaaaatacccaagtagaactattctagaaataaatgtaaataataataattatagttataattataatatttactataccctttttttattatacagaaaaaataaaagatagaaaataagtaatttgaatcgttcagtcaaaaaaatcaacaatccccaacagcaacgccaaaaatatgatgcgtgcaatatacagtttttgtagtattgtattgattaacgtaattgcacaatggcaagtgtaccagtcattttcattaaataataaagttagtatgtagagtatcgtatccacatggattgtcctttcgtccgaacaattcttgttacttatttttgtaagttttcacggtataaaagtgagttgcaatttttatttgtttgcaacagagcgaatttacctattttggctgcagaaaaataagcagcggttaggattcttcgaatcccctcgggatatttattgttagataatacgtaatctaaatgtcgcgtttatttatctcttggtgactattgaagtgataaggccgttgggagtttcctaaataggtagggcaccacctgacccaatgggttttagccactatgtacgtaattaggcattttccttcgatggctaactgcacctgttgatcgcacgatgatccttacgtgcgaggtcttgctgtaacaacccgatttttagctagatttattttaattacttttattatgtgttttatgtgtttgtgtgtgattattcatcattgggtgcatttgcatgggtttccgtgttagaagggtattttagtcattttgcacttaggggtattttggtcattttgtgaggaagggtaaaattataattttagtgtgaattacttttagtgattagtgagaatagttattttactaagttactagagtaaaattgagattttaccgtttagtgaccgttaccgttattagttatttacccgttagggtgtagaaattttgagatgtgaaaagagatgggttaagtccactagaaactaggttaagctattaaggggtataccaaatgagtttgtcttaggaaaatatcacttcattcatttcataagatattttctagagaggtagagagagaaagtgggtgaagagcagaacaagggttagagagaataggaacttgaagaattcaagggtttgaagaatcataggagcaaaagtgaagctagagctaatagttggagataattaaggtaagggggttagtcttcatcataatcatcattatttgtaaattttcaaatgttgtatgaatttttgcatgatggataattattgctaaattcgtgctccaactgtgatgatatgtttgtatgcatgaattgatgataattgtatgattgttggtgaaattacatgttcaaataggaacaaatgttaagttgtgaaaattgtgctcaattggtgaattttgctaagttgttaaattgacatatgattcttgttcaattgatgttattgttgttaattgatgttttagttgatgaatcactgcttgggtatgcaaattcatgaattgatgatgataatttgagatgttgttggtgttttgatgaaaatgatgagttggtccaattgtcaagtgttttcaagtttgattgatcctttgtgagttgctttagtcatattgacctataaacatgttctggaaacacatttgggtaatgagggatcaaaattgggaattttgggtgtaaaggggtccaaacccgtaaccttttttgcaaacctgtgaaggttcgcttagaggttcgcttaagcgacctgataagcaaacattcatatggatttttctgggttgggtcgcttgatcgaccggtgagcgaactagtaagcgaagatttctggttgctactggaactcgttcgcttaagcgaactggtgagtgaccagatagtgaacaaagtgatttgctactgtaacttgttcgcttaagcgaaccaagtggtcgcttaagcgaacagctccagtttcagtcactttgatcttttgttccgggtctttgggggccatttcgaggtttcttaaatgattcttgaagcatgtttaactactgttaatccccaaaaaacctactggaacaatgattgcttgcctaaacttgaatttcttcaaatgagtcttaacttggaaaattttgggaattcaactttgtcgaaaaataacttttgtaaactaatgaagcttgcaagttgaacctacagttcatataggcttaggtaatacttgtaagagtggtcaaacatcttaatcatgtagaaagtgataattcgtgtgggaaagtgaaaggttgtgaaaatgagattttcatatgaacttaagttgtgcttgggttaatgttaatgatccggaggcgacttaacttcatgattatattgtcgattaagattgtttgaaggttttcaacttgtcttttgtcttgggttttgtcaatgttggccggtggccacatgatatggtttttggtcgaaaacgtttcttgaaccaattgtcctaagaattgaggtgactatgtttgtatgactaagtgaagttgtatgaatgaatgattgttttggatatgatatttatcatgagatgtgtattataacgcccacttttatttaattaattatttaatcgagtctagatgagttatattatatttatataatatatgcatgaattgtaacgcccacttttatttaattaattatttaatcgagtttagacgagttatattatatttatataatatatgtgtgaattttgatgatttatgacgatttagattatttggaagatttttagatgagttatgtgttttgatgattttatgagatatgagacttattttgttgtttaataaaataagatttgaaaataaaataaaatatttagttaagggttgttttgagattttagagagttttgggggagaaagtgagataagataagattttaggaggagatataaaaaggaaagacctaggtttgtagaaaattagtacgtacgatcaaactttggaaaaaggaggaaaaagccatagaagggagaagaccaagagagagctgcgattttcttcattcaaggtaagggtgagactaatgattcaatagtgttaatctatacaattctgatgatcaaattaacaaattaggattgaattagaaagtttatgaaattagggttaataggtgaaattgatgatccaatgataataagctgttagattgatgcataaaacgtcctttgaccttagattatgtttagaatgaattatggaaatgaaattaggcttagaaccatgtgagatcatgaatttttcataaaaactgcattctgcccgagcctgtattcatcgctcgccctcgtgaacgatgatcctcgcctcgcgagggatgaagttcatcgctcgccatgcgagccatttcccctcgcctcgcgagttacaagtcgtagctcgccacagcgagcatgaccagagagcatgttaaagtggtagcttatgcgtccaagttgggtttaggaggtgtacttatgcaagatggtaaagtggtagcttatgcttcaagatagttgagaattcatgagaagaattacccgacgcatgatttagagttggcggctgtggtctttgtattgaagatatggagacattacttgtatggttcgaggtttgaggtgtttagtgatcacaagagcttaaagtatttgttcgatcaaaaagaattgaatatgaggcaacgaaggtggctcgaattattgaaagattatgactccgccttgatggttagagagttcgagttaattgagcagtttagagatatgagcttggtttgtgaatggtcatctcagagtgtgaaactgggaatgctgaagattaatagtgaatttctgaagagtattaaagaagcacaaaaagttgatgtcaagtttgtagacttgttggttgctagtaatcagactgaagatggtgactttaaagtcgatgaccatggtgtgttgagattccgaggtcggatttgcattcctgacgatgaagagatgaataaaatgattcttgaagagagtcatagaagtagcttgagtattcacccaggagctacgaagatgtatcatgatctaaagaagattttctggtagtctggatttgaaacgagatgcggcacagtttgtgtattcctatttagtttgtcagaagtcgaagattgaacatcagaaacctgctggtatgatggtatcgttagacgtgccagagtggaaatgggatagtatatccatggattttgtgacgagtttgccgaatactcctagagggaattacgcaatttgggttataattgatagattgacgaagtcggctcattttctaccgataaatattagttttcctgtggcccagttggcagagatttatattaaggagattggaagttgcatggtgttccttcgagcattgtatcagatagagacccaagatttacttatagattttggaaaagtttgcaagaggctttgggttctaagttgagattgagttcggcttatcatccgcagacagatggtcagtcggagaggacgattcagtcgctagaggatttgttgagagtttgtgttcttgagcaaggaggaacttgggatagtcatcttccgttgattgagttcacatacaataatagttatcattctagtattggaatggcaccttttgaggctttatatggtcggagatacagaactccgttgtgttggtttgagtcaggagaaagagtggtcttaggaccggagattgttcagcagactactgagaaagttaagatgattcaagagaaaatgaaagtgtcgcagagtcgacaaaagagttatcatgataagcgcaggaaagatcttaagttccaagaaggagaccacgtattgttgagagtcactcttgtgactggtgttggacgtgctttgaagtcaaagaagttgactccgagatttattggtccgtatcagatatcggaaagagttggaacggtggcgtatcgagtgggattaccaccgcatctttcgaatttgcacgatgttttccatgtgtcgcaacttcggaagtgtgtcccggatctatctcatgtgatccagagtgatgatgtgcaagttagagacaaccttacggtagagactttaccggtgaggattgatgataggaaagtgaagacgttgagaggcaaagaaataccccttgttagagtcgtttgggacggagcgactggtgaaagcttgacgtgggagctagagagtaagatgctcgagtcttatccagagttgtttgcttgaggtaaattttcgaggacgaaaatcttttaagttggggagagttgtaacgcccacttttatttaattaattatttaatcgagtttagacgagttatattatatttatataatatatgtgtgaattttgatgatttatgacgatttagatgatttggaagatttttagataaattatgtgttttgatgattttatgagatatgagacttattttgttgtttaataaaataagatttgaaaataaaataaaatagttagttaagggttgttttgagattttagagagttttgggggagaaagtgagataagataagattttaggaggagatataaaaaggaaagacctaggtttgtagaaaattagtacgtacgatcaaactttggaaaaaggaagaaaaaagccatagaagggagaagaccaagaaagagctgcgattttcttcattcaaggtaagggtgagactaatgattcaatagtgttaatctatacaattctgatgatcaaattaacaaattaggattgaattagaaagtttatgaaattagggttaataggtgaaattgatgatccaatgataataagttgttagattgatgcataaaatgtcctttgaccttagattatgtttagaatgaattctggaattgaaattaggcttagaaccatgtgagatcatgaatttttcataaaaactgcattctgcccgagcctgtattcatcgcttgccctcgcgaacgatgatcctcgcctcgcgagtgatgaagttcatcgctcaccacgcgagccatttcccctcgcctcgcaagttacaagtcttagctcgccacaacgagcaaccttactcgccatagcgagcatgactagagagcatgttgaatttcgtaattttgacttttgagttgaaccttagatgcttttgagtgccttaagatgtttattaaagattagatgatgatttagaatgagattgaacctggtttagcttagaataactttagttggaattctggcttgaactcgccatggcgagcagatgctctcgcttggcgagcaccttcagaactgaatgcaaattaggatgttgcgatctgtgtcgcacaaattgattagggttggacccttaggtagtaatgtgacctatttaagatattaactgaaatatgtgaggctgtttgaactgctaagttgtttgtaatgtgatttaatgattaaatgcattacttgaaatattattgaatgatcaagatgttgttgaaatgaattggtattatgaaattatgctgttgttgtgatctgcctatgctgctattgttatttcactaagttgcatgagtcattataagatgatgttgaatatccaaattattggatatgtatatgagatgatgattaagatggtttagatgattgagtccatgcattagcatacatttgttgggggctcatgccctggagctttgtactcaccatgatggagcatttgctcaaaataactgttgggggcttatgccctgaaagtatattaatactataatgttgggggctcatgccctgaattggtaccacattcatataagaggtttaggttgcattgtcgcattgtcgagttaaatgatgaaagatgttatgttatttattatgattgaatgaaatgagtacttgatatttgattaccaaagatgtataatgtttaaggtgaccatgttgaagatgtttatgttattaattgcgattgttgaattatattgattaatattattgttttgtgaaatctcaccccttctgcttggaaatgttgctcttcgtatgagtaacttgcaggtgatcgagcttagtgtgcagtgttgctgtcgtgagtggccttacctcactgagttgtctaagttgctctgatacgtaacatgatgaggtttatgttatgcatgcttcattcttttacgtgttcatttatgatgattaactgaatttattaagatgttttgatgaggcctgcgtgccaaaactttatgatgatttgaatttaattccgctgctatttggttgatgaagggtaaattattatttatctatgtttttaagatttttaagaatgtgatatcccgttaattgatgattactctaatttttgttaagaaatttttatattgggaaaacggggtgttacatgaattatgatgaattatgacgatttagatggtttggatgagttatgtgttttgatgatttttataaggttatgagacttattttattgtttaataaaataaaatttgaaaataaaaataaaatatttagttaagggttgttttgagattttagagagttttggaggagaaagtgagataagataagatattaggaggagatataaaaaggaaagacctaggtttgtagaaaattagtacgtacgatcaaactttggaaaaaggaggaaaaagccatagaagggagaagaccaagagagctgcgattttcttcattcaaggtaagggtgagactaatgattcaatagtgttaatctatacaattccgatgatcaaattaacaagttaggattgaattaaaaagtttatgaaattagggttaataggtgaaattgatgatccaatgataataagctgttagattgatgcataaaacgtcctttgaccttagattatgtttagaatgaattctggaattgaaattaggcttagaaccatgtgagatcatgaattttcgtagaaaactgcattctgcccgagcctgtattcattgctcgccctcgcgaacgatgatcctcgcctcgcgagtgataaagttcatcgctcaccacgcgagccaattcccctcgccttgcaagttacatgtcgtatctagccacaacgagcatgaccagagagcatgttgaattttgtaattttgacttttgagttgaaccttaaatgtttttgagtgccttaagatgtgtattaaagattaaatgataatgtaggatcagattgaacctagtttagcttagaacaaccttaggtggaattctggcttgaactcgccatggcgagcagatgctgtaacaccctctttgaaatatttgattgttttaataagtttagaatatatttatatgattatgtgatttattaagtgacttattttattatttaatggaataggatttgaaaataaaataagattaaagttgtgggggctgttatggaaattagatgagtaatattttgttatgttatatgttcgtatttattagtataatatatatgttatttggtttagaaatatatatgttatttgttatagaaatatatttgttatagagatatgttgttatttgttatagaaatattttatattatattatattatattttatatatatatatatatatatatatatatatatatatatatattagaatagaatattgagacttgtatgacatatttggaattaagagaaaataagtaggttaaagatttatataaaaagggagagttataattagaaaataaggattacgtgcaaactgcttttgggagaaagtgagaaactaagagaagtgagaagttagagaaaaacaagagaagagaagaaccatgaggaaaggctgccgatcgttaatcttaaggtaagggtgggactaacattcaataatcttgagtctatgattctgaaaattgtatttaacatgttgtaggtttagtttttgagaatttgagaattagggttaagagtgatgattgtgatgattttgaatgaaagtgaagttgaataatataggttgcttttttctgatttttcttttcatctctgccgcgaatttgaaatgaaaattggtattgattggtacagaactggtcttaggtgtaaacacgaaagttgtaggtatggatgttagctttctaattccgttggtctgatgtcaaaaagatttatagaacttgagttatggtcaaattactatacgtaggtcacagtgaatttttatgaatttcagcacaactttgtccgaatttgaaatgaaaactggtattgattggtacataattggtcttaggtgtaaacacgacagttgtaggtatggatgttagcttgctaatgccgttggtttgacttcaaaatgatttatagaacttgagttatggtcaaattacttcacgtagatcacagtgaataattgaatatgattgatgaattagtatatgtatgtatatgtttgtgaatacgatattgttcatgattgatgaagtgttatatgtatatatgatgttttaagatgttgattaccatttgatgttgttatattgtgatataattatatatgcattacttgaattatatgtgaataattgagacgttgttgacttgcatttgatattattatgtcatgctgtttttgtatactgctgtgttgctgttgttatttaactaagctgcatgagtcggtctaagttgattaagatgttccaaattattggactatttaagaggtcatttaattaagatgtttaagtggtcgagtccatgcattagcattcagcgattggggcttgatgctccggaagtataataatactcaaatagcgattgaggcttgatgctccgaaagtataataatactcaaatagcgattgggacttgatgctctggaattataataatactcaaatagcgattgggacttgatgccccgtattggtaccacatgcatataagaggtctaagttgcatagtcgagttgaagttgcattgtcgagtcaaagtcgttgttgatgaattatcatacatgagttattaagttgttgatgaattatcatccatgagttgttaagttgtcttctatccatgtgtagttaatgaagtacttatgaataattatgattatgacattgttatgttgtttgtgatattgactatgatgtttacgatgtgatgattatgttgttatgatgcttatgaaaattgattatgatattgtttatgatattgatatgatgttgattatgatgatgttatgatattgttatatgtgatgaatatgatgtttatgttgttataagatgatgtttatgatgtgatgattatgttgttatatatgatgaatatgatgttaatgatgattagaagttgattgatgatttaatgaagtattacatgaagtattattattgctaagtgatgaagtttaagttgttaaatgtaattgatgaattatatgcttaatattattatttgtgaaatctcaccccttctatgttgcccaccatgggtaacttgcaggtaacccaccatggcgcattggatattccaaatggcatcacagaatactcatagtgtccataccttgttcggaatgcggttttggatatatcttctacctttcctctagtatgatgatatcctgatctcaaatcaatcttactaaacacctctgcaccaaccagctgatccatcaaatcatcaatccttggaagtggataccgattcttaatcgtcactttgttcaactgccgataatccacacacatcctcatgcttccatctttcttcttaaccaacaacattggagcaccccacggagaaatactcggtctgataaactgcttctcaagcaattcttctaactgttccttaaattcacccaactctgatgcagacattcgatacggcgcaatcgaaataggactcatgcctggtaccaaatcaattgcaaactcgacttccctctccggcggtaactcggtaatatcatccggaaaaacttcagcaaactcttgcactaccggccaatcactagctcctttctcaccactaaccttcaatgatgcaaacatcatgaacacacaagcttcaccatctaaagatttcttcacttgctccacgttcaagaacttcctatctaactcttctaccggcttagaaaaagttacactcttagtcaaacaattaatgctaaccccaaaagctaacaaccaatccataccaaaaatcacatccatatgcttcaaaaatcacaagatccaactcaaaatcaacattaccaaaattaacaggacacttagcacacataaaagaagtagtcaccgaaccgctagccggggtgtcaataaccattccccgcaacaaaggagtcaaaatcaatttcaaacgttcaacacaactaaccgagataaaagaatgagtagcaccagtatcaataattgcaatcaatggaatactattgataaaacacatacctcggataaggttatccggttgctccacctcctccgcattcaaggcaaacacctttcccaccaccttcttcggcttggtacacttagtactaatatgacctttctctccataattgtagcaagtaatctcctttgcaacactcttgcattcataagccttgtgacccgctttctcacacttgtgacaactgatatccttcttacaatcattagcataatgacccatatttccacacttgaagcatttgacatccgccaaattcggcttagagcccccaccagattctctcttctttcctttgtccttgttgtacggttttccaactccatggccccttcctctcttatcattctgagccttgtagtaattagtctcagctttcccagcatcatcaaacatcaacagttatgcaccaaagtatcaaagtctcggatcccctggacacacatgtactgatagatatccggcctaagcccactctcaaacttcacacacttcgaaaccatagcatcctcagcattgatgtagggacaaaacctcgaaagttcctcaaacttcgccgcatattcggctacagacatgatccattgtttcagattcagaaactcaatctccttcttggtcctcaagtcttcggggaaatacttcctcaagaattcaaccttgaacttagccgaggtcaccacattcaactgagcctccacaaccaaagataccttcccttgccagactaacacaaaccactaaccgataagaaaacagcacaacaaagcaaatgccgaaggtactatgctaccattcgcacacgacagggaaatacaacaagtattagtctagacacgactgaccatggctctgataccaacttgtaacactcctatttctattaaagcaattaaacatgcgaataatacatttattcaagaaataaaggctacgccacattcaaaattcaaaaaccaataaacatgtatataaacctcaatagtcgcagcggaatataaaccaaaataatccaaatatacatgtcatgaataaataattacatcaacataaatgcatctcaaaatcccaacatacgggtaatctccaaacataacaaattccaagcaaaagataatctagactgacataacgaagcctagatcagagccgactaaacactaaacaccgatatcggagaaagctcccgatatcaccaagcacaaactcaccaagcactactcctgcacaatgtctacccatccatacagacaggtagacagctaaaacctctgggggtaagtattacatcatcataatcaaaataataattaacatggatagttcaatataaacatcatacattgatcaataatgatattcaaatatatacatatatactcacatcaaaaccccaatatctcacatcaataatcaataatcacatgtgtcatgaacaaatatcaatttccaattattcacacacaatcaccgaacacatatatgaataagactcatgtcatgatatgcacctatcgacacatatatgcatgtggtaccaaatcacctcaaggtcatcacctaaatccagaccactaaaggtttttgcaagaccgaagtccacaactagatctcaaaagatctctgcaaggccggaggccaataatgaataaaacatcatataaaatctccacacgactatgatgcatggacatgtacaaagactcgataatgtgacaattatccacaattttcacctcaatatataggacaacacccaattatattgattatctccacaacatttgcattatcaagaaaacatgtccacgcacaattaaatcatagcattcatcatcaccacatcaacatgatcatcaatactcaacaatgttattccacatcaactatcacatatagtttcaccaattcaagcatttcttacatcctaagtaaggtagcatgcacatctcacgataagcatcatatctcatacaatcattcaatcatacaatttcacttagtcatataagaatagtctccataattcataagacaattgtgatgaacactattttatgaaaattgttcatatttgacttttaattatgaattgataaaagttgcttgctgaaagattaattaaaggcgcaaaacacaagaaatgaactaaaaatattgttaatgaaagggtgtgccaaaaagaaacgaaaattatgtattgagattaattttgacaatgatttgagttgaaaatgagaatttggttttgaattggtgtttaggctgatttgtggtttcaatcaagaaatggaatggagagtttagggacgccacactttctaatcctagaaaatgataagtctatggaatgaagatcaccacaagaaaggattcttgatatgatcaatacaaggtccaatccagaacctaaagagcaattactcacttttttttaacaaaaattaacttgtcttttattgatgagataaaaccgcaagtgcacggtcttaccgaagtagtatgaaaagagtatcgttccgacagggagtagtttaattcaattaacctttgataatgattagaggagaaaagaattgtaagttggggttttcaagcgtttgaaagataataataataaaaggagccttgggatcgttggttcatctaaatgacaagtccttcacaaaccaaactataagcttataactttatgttagacctaatttctcaagacagtttctcttttgttcctctagcagccaagcctatttcgctgacttgattactattagattttggttcctctaacaaccaagcctatttcgctgacttgatcattattagttcccttgaagatcgagactatatgtctcaaagattgcaaagactatttcgctgcctttgcaatccttgtctaaattcacttgttcaaatatcaaagctccactttcgttttatgaattgatatttgagatcatggataaacaattatcaaatcctccactttcgtttctacagtttgataatggttgatccatgttaaagcggtgaatttagataagaaactagggttacataaaattaaggcttagagattggcttgattaggattatttcatttagacttatccaacaatcccaagacaaggagaagtctactcactcatgttcatcgtagacatggggaagaagagagaaaataaaataaaatgcaacaatccctttcttttgctccaagactcaatccatccaatattcattcttgaaataaaataaaatgcaatttgtagtaaactatcttaaaaaggaaataatactaatataaaataaaataaaatctaattaaaactaaactaaatagcatataaaaataagcaataaatgactcatcaaactcccccacacttgaatctttgcttgttctcaagcaaaaggcataaacatggtagcataaaataacattatcatatgacaattacattaaaacacatgtctcctcaaaggcttttatttcaaagagtacactaatcacaaactcaagcatttcttataatcctttttcaacccaacaatcaagtcttaagtgagtgtgtgtgtgtagtccaacccttttcttgctcctgtataagatagatataaggaggaacatgttctaatcctagtactaaattaaccaagaaaaattcttctttcaattcatataagagagatgggagtttttgtgatctttttgatcttttgccaattacattttgggtactttatttaaggaacaacaccttcacgtaggaggttggagggcctacccccttccccaatctagattcaatggtgccccttaaaaacatcatcgtcacgtaggaagtcggagggcctacccccttccccaatctagattaaatgatgccttttaaagtttcttttccaagataacattaccttcacgtaggaagtcggagggcctacctccttccccaatctagattcaataatgcaaccttgaaataaattttgagcttggctttttataatctcctttaaactaacttatattatttttactttgagaatttttaaagattaacgtacaactaaaattagaacgcatttccttaaaatacctattcatacatttactcaagggaagcaacttgtgcattttttttattcactttaaaacaagatgtgggtatataaggagaacttaaaacacaagagtttactttcatgtacaagaaacgaccaataagaggagacaataaaaaaaaaattatgtcatgatttttcaataaaaacaagctacttaatcatgcctttcactatgaaacaaaacaaaaagaataaagttcaagggagtttggaaacactacgactaaagacactttattaggctccccccacacttaggagaagcattgtcctcaatgattcaagatagaagaaagagaagaaggagaagaacgagatagagattgaagagataaggtgaaaaagaggaagaggaaagctcacatttttattgaggtccatagggaggaccttggaggtggaagtgttgcatcatgttccgaagcatttggttattctcttcggatatgcggttgcctcttaggacatcattccttagcccggataattcaacaccttgcctttgttgttcggtgcttatcctttgtacctcagtttgcatccatgcccatctttcattgttggcattatggtcatggggctcctctttatggtgcatgtttgcaccgtcttcttcaccttgattatgctcttcatgtacgtgtaatccatcaccaacatacaacaaattcgcctccacctcggtgttagtccaagatgggttaggaagcagaaataaaagaggtatacgaagttgaagtgcataagtcatggatggatgaagcttaatgaaattcatagataccagggtttcaatattaaacctattgttgccctcaattgaatttattccttcggcttcactcactccaaacttcctagcgatgaaggtgatgataccactgactactatcttagctctattatcaggtctagcacctatggaggaaaggtaatcaagtaggtagaagcaagtatgaacggggttgttaccaagcattgcccaaagcataaagagttcatccgtcctagttgttcctacttctattctaccctaaatggtacaagccatgactctttagaggtatctaagcactgggttgtgaatgttactagccttattgttgcgaggattatatttccttaacccggtaatgcgtttccaaaagagagcggggtcatagtcttccgactttagatttggattccaagagtcatggatgaaccccgcatttgcgaagtccatctctaaagaaaattttttaagagacatctcgtaatctatattcaaaagtcgaaaggagactctatggtcggggttatcaaagttcactttattcttcggaaattcaatagaacttaagaattcataagtgaaattttcaaaacctttcataggtctaagcatatcaacccatcctaaatttcctagtaagctaaacacattatcccttagtcctagcacactcaaagtataagaatcgggatatcgacaagggtgcaaaggtttagagataagaatcttatacctgttcctttgcttggtgtccttgaagattatgccttgattcttggcttgcgttttcttctttgattgtggtcctccggaagagcttgctccacctttcctagatgccattatccttaacctgggtttgaccttttgtgatggtggtagaggttggtttagtgatggggttaagggttaagtgagttttaagagttgggttgtggagtttggtgatgaatttgtgggttttgggttaggttaatgggggtgacgcatttgggtgattttggtttggatggatgaaagttgtttttgaatggtgtgttatgattggaatgttgtttgtgattgatggggtaaagaaatggtgtgaattggtgaagttttgagggagatatggaggtttgaggttttgtggttatggaggttttagagaaaaatggaaggatgagggatgtttgtgtttgagaatgggggatgaagaagatgaaaggtgaggtaaatctgtacctggagtcgggcacggccgtgccaaccttagcacgggccgtgccaagttcctggagttttggtgggtttttgaaaggcaaggtctggcatggccgtgccagtgtgagcacgggccatgccaaggttctggatatagtggtttcaaaattttccgttttcttgaatcgtactcggacaattacctacaaaacatttaaaaacaagcagttaagtgtgtgggttttgtaacactcctatttctattaaagcaattaaacatgcaaataatacatttattcaagaaatagaggctacgccacattcgaaattcaaaaaccaataaacatgtatataaacctcaacagttgcagcggaatataaaccagagtaatccaaatatacatgttatgaatcaataaattagatcaacatagatgcatctaaaaaatcccaacaaacgggtaatctccaacaaaacagaaaccaaagtaaaagataatctagaccgatacaactaagcctagatcagagccgactaaacatctaaacaccgatatcggagaaggctccagatatccaccaagcacaagaactcaccaagcaactaaacctgcacaacgtctacccatccatacagaaaggtaggcggtccatcataaatccactggggtaagtattacattatcataatccaaataacagttatcatgaacatttcaattaacatcatgcatttgatcaataataatattctcatatcaatacttacatcaaaccccaatatctcacatcaattatcaccaattacatgtgtcatgaacaattatgaattcacagttattcatacacaatcaccaatcatatacaccatgaacaatcattaatcacatttcattaacaatcattaatcacatttcatgaacaatcaccaatcatattccatgaacattcattaatcacacgtgtcaaacatcaattcacaaatattcattcacaatcgccaatcacaatcatcattaatcacatttcatcaccaaccacatatatcacataagactcatgttatgatatgcacttattgacatataaatgcatgtggtaccaattctccaaaaaggtcgtcacctccgatgataaaacacatcgtatgtaagggttcacccccgccttacataatctccgaagtaaaagagctcaacccttttacaacaactcgactatgatgcatggacatgtataaggactcgataatgcgacaacaatccacaatttcaacctcaatatataggacaacacccaattatattgattatctccacaacattacattatcaagaaaacatacccacacacaaatagatcatagtattcaccattcacacaataacttgattatcaacaatcaataatgtcattcaacatcaactatcacatatagtttaatctatccaacatctactacatcataagtaagataacatatacatctcattaacatatcaatcattcatacaatttcacttaatcgtataagaagtcaccgtaccaacttgtaacaaaactacatagacaagttgaaaaccattaaacaatcttaatcaacaatgtatacatgaaattaatttgtcttcggatcatcaacattaatccaagcacaacttaagttcatagaaaaatccaattttcacaacctttcatttcccacccgaaatatcattataatttgattaagatattgaccacccttgcaagcatcacctaagtctataatagctgtaggttcaacttgcaagccttattaacttacaaaatttgttttcgacaaagtttgaaattctcaaaatttcacaagttaagattcaattcaaaaattccaagtatatgcaagcaatcattgttccagtaggttttggaggattaacagtggttaaacatgcttaggatatcatttaagaaaactcggattggcccccaaagacctggaacaaaagatcaaagtgactgaaactggagctgttcgcttaagcgaccacctggttcgcttaagcgaacaagtcacagtagcaactcactttgttcgcttaggcaaactggacccagaaaaactatgagtgttcgcttaccaggtcgcttaagcgaacctctaagcgaaccttaacaggtttgcagaaaaagttacgggtttggacccctttccactcaaaatatatctcaaaccatcaacacattcacattcccaagtacataaatgcatactcaattattcactctaagtacttcattaaacccaatatcaagtttggaaaagtttcacggctcaaagaaaaagttatgataagttttcataaaaattcatatgacccatgtgtagtaatttgatcataactcaagttctaaaactcatttggacgtcaaaccaaagccattagaaagctaacaaaattatctaaaactttcatgtttacaccgaaggccaattcaaaacagaaacgtgtgaaaaagacacaagaacgcgaaataagaaatgctgtcaaaagggcatttcgcttaagcgaacgagtattcgcttaagcgaactacttacagtagttgttcgcttacagctcgcttccgtatcgcttaagcgaacagtcatcatttctgcataatttttcacgtgtttaaaccatttttcaccccaaaacccaaattttgatccctcgatgcccaaatgtgtttccagaacatgtttataggtcaatatgactaaaaagactcacaaagacacaataaaacttgaaaacacttgacatttgagctaacttatcattttcaccaaaacaccaacacaattcaaattctcatcatcaatccatgaatatgcatacccaagcaattactcatcaaccacaacatcaattaacaaccataacatcaattgaacaagaatcaaatctcaaattaaaaacaacttagcaaaattcaccaattgagtacaattttcacaacttatcatttttgcatatttgaacatgtaatttcaccaacaatcatacaattatcatcaattcatgcatacaaacatatcatcacagttggagcacgaatttagcaacaattatccataatcacaattcatacaacatttgagaatttgaaaagtgaagatgattatgataaagactaacccccttaccttagatagagattaacccaaactcttgcttcaattcagctcctaagcttaccccaattgattccacaagctattctcttcaaaacccttgttcttctcttcacctctttatctctctacctctctctctaggaaacttttatgaagtgaatgaaagatatttttctatgacaaccctaatgttatctcccttaatgggctcaatcttagaccctaatgggcttaacccattctaacacaattctaaaaagtttctatacactcaacggtaattactaacaacggtaaaatataaccaacggtcactaaacggtaaaaactaatcactacactagtaacttagtaaaataaaggttctcactaaatattaaaataattctcaccaaaattaccattttacccttacccgccaaatgatcaaaatacccttctaatatggtaatccatgaaaatgcacccaatgatgattaatcacacacaaacatataaaacatataataaaagtaattaaaataaatcgagctaaaaatcgggctgttacaggttgcctcccacaaagcgcttctttatagtcattagcttgacgttaagaaagtgtccttagaagggatcaaataggtcatattgtgtacatgacgctaatgagcgttctttcacatcatgacctttaatcatgttacaagaataaagagcgggacctttcataaaattctccaactcaaatcctatcagctcatcactcacttgaaaaacaatgctaccattctgaacatctactatagcacccgcagtggcgagaaagggtcgtcctaaaattatagggcactcattgtcctcatctatgtcaagcaccatgaaatcagttgggatgtatatcccttctattttaacggggatgtcctcaacatatctgacaggttggatatcagaacgatcggctaacttcaatactgtttcggtaggctttaactcccctattcccagccttttaaagaggggtaagggcaacagactaacactagctcctaaatcacataaggctcgatttaaggtttcactccctatcatacaagggatggcaaaacttcctagatctctaagctttggaggtgacttcttgatgatttcacttttttctcttgtcaaagctattgtgtcattttgctctatagcctttttctttgaaaaaatgtcttttaaaaacttggcatatagaagcatacgagacaaagcttcagcaaacggaatctgaatgcaaatctttttaagtttgtttaagaatttattaaattgagcctccaagttaagcttaacgagccttaatggggaaagggctttgttctcgtcaagtggtttctctatcgcatccttctcacctagaagcttaacactctctcccttgacacttttggctttagcaacggtctcttctaacttactacccccaagagaaatagcattgacatgagctttggggtttgtttcaggttgaccgggaaagactcctggtgtttgagaagaggtggccacttgttgggccacttgggagatttgggtttcgagcattttggtgtgtgtggcgatagaatcaaccttggtagtgagtttggagagagagagtcgttcagaaatcctgttcgcttttttagttcttggagttgtttattctgattcatcatgcaattttccaacagaattttcgaacctagatttctgagccaccctctggttgtttgtatagctaggtggtgctacttgcccataggaaccttgagggtttttgtaaaagttttgatttggcctcgttccttggttgtattgagcatagtttaattgctcaatactgttagtagcactacctaactaacaatcaacaccaatatgaccaaatataccacagatttcacaaggaggagatgtaggagaaggtgtgacagcattaacattaagtttttcaaatttttgagttaaggcatcaacctttgcagcgaggtgatcataatcggagacctcgtacatacctgcctcctttttggagggagtagaggcggtaatggctctttcgttggtccattggtaatgattctgagccatgtctacaatcaaagcataagcctccgtgtagttcttattcattagtgctccacctgcagctgcatcaacagacatcttagtggtatatgttaggccattataaaaagtgtggactatgagccacttttctaaaccatggtggggacaaagtctaagcatttccttgaaacgctcccacgcatcatagagagactccccatctttttggttgaaccgcgtgatttggtctcttagtttggcggttttagaagggggaaagaatcgggcaaggaatgctcgcctcatttgatcccatgaagtgatggaaccgacttctagggaatggaaccaagcgctagctctatcccttaaggaaaagggaaagagatgaagtcttacggcttcttggttctcttttatagttccactgagtctaaggaaggaagaaatatggagatttggatccttggtgggtgatccagaaaactgattttgctgcaccaaattgagtagtgcaggcttgatctcgaaattgttaccctcaaccgttgggtacacgataatagcttgtggctcttacgttgaaggagtagcatactctttgagagcgcgttcaacgatagcaatattattttgtgcctctctttttttcttatgcaaatatctttcgatctcaggaataaattctccgagacttttacttcttcgcataagaaatcgagaacccaagaagttaatggtaatataaagaaagaaagaagtagaagaaggagttctaatcacaaagaaagagttaattatattagtttactcccccccggcaacggcgccaaaaacttgatgagataaaaccgcaagtgcacggtcttaccgaagtagtatgaaagcgtatcgttccgacagggagtagtttaattcaattaacctttgataatgattagaggagaaaagaattgtaagttggggtttcaagcgtttaaaagataataataataaaaggagccttgggatcgttggttcatctaaatgacaagtccttcacaaaccaaactataagcttataactttatgttagacctaatttctcaagacagtttctcttttgttcctctagcaaccaagcatatttcaatgaattgattactattagatttaggttcctctaacaaccaagcctatttcgctgacttgattactattagttcccttgaagatcgaaactatatgtctcaaagattgcaaagactatttcgctgcctttgcaatccttgtctaaattcacttgttcgaatatcaaagctccaatttcgttttatgaattgatatttgagatgatggataaacaattatcaaaccctccactttcgtttccacagtttgataatggttgatccatgttaaagcaatgaatttagataagaaactagggttacataaaattaaggcttagagcttggcttgattaggattatgtcatttagacttatccaacaatcccaagacaaggagaagtctactcactcatgttcatcgtagacatggggaagaagagagaaagcataaaagtaaatgacaagaaaataaaggaaaagaaaagaacttttattagaaaagcaattgtcacttattgaattccaagaaaagatgaatatttgtgatggatggctactctatttatagcatacattcgacttaaaatctaagcaattatattcgggctaaaaatagagtagcttaaaatctaagcaaaagcagcaaaagtgactctggagggtggcacggccgtgccaatgctggcacaggccgtgccaagcttctgactttgggggagacgtatttttgtctccgaatcttcgtatttttgcattcaatcagctccaagtccctttcttttgctccaagactcaatccatccaatattcattcctgaaataaaataaaatgcaatttgtagtaaactatcttaaaaaggaaataatactaatataaaataaaataaaatctaattaaaactaaaataaatagcatataaaaataagcaataaatgactcatcatttattcaattttcatgtcctatatataggtaggagggacacttgctgaattacaaagaaaaatgcaaataactcttaggattccttcaaccaaattaatctatcattatttcctatggctgaagtaaattaacatgaatacaagaaatggttacaagacaaatcaatgaatgagggtggctggtcttaatgatcatgatgatggacgtgattttgatgatgatggtggtttcatatgctgaaatgaaatgccttcattgtttcattgaagtcttgtccctttcctcttcaattcttgcattctttcctccttcagattaaatgctctttaatgccttgtttttcttttgtcttcaacactcctttgcacgaaataaacacacaaaacattccattcaaagctttggaagctttaaaatggattaaacacacaaaataaccatacttagtgtttttgggccaacattggtctttaacactttttattacaacataacaagaacaactaaataaaatgggcagcaagagatgcgccccacccctcctccaatggtttgatgcacatgaccattttatcctccattctttctagtgtaggtttggactccaagacttttgccaccaattgagttagggcctccttagctttcttggtcctcgaccttgtcattggtcctcctagcccttgaattgaagcacttgtgtcatgcacaaccatgccctcatcatcctctccctcttgaaaggaattcgtccacgaattgaaatcaccattacctacatcaaaaggagctaagtcagcaacattaaaagtagcacttatatcatactcaccgggtaactcaagcttgtatgcattgtcattgatcctttctagcacttgaaatggtctgtcaccccttggttgaagttttgacttcctttgtttaggaaacctttctttcctcatatgcacccaaacccaatcaccgggttcaaaaatcaccctcttcctttctttgtttgcacttttagcatacccttcatttttcttttcaatttgcaacttcacttgctcatgcattttcttcacaaactcagctttgtcttttccatctttatgcttcaaaaaagaactattaggcataggtaacaaatcaagtggagttagtgggttaaaaccattaacaacttcaaatggtgacatttttgtagtactatgaaccacacgattgtaagcaaattccacgaggggtaaacattcttcccacattctcaaatttcttgtaagaacacttctaagaagagtagagagagttctatttactacctcagtttgaccatctgtttgagggtggcaagttgttgagaatagtaactttgttccaatcttaacctacaaggtcctccaaaagtgacttaaaaattttgtgtcacgatctaaaactatgatccttggaactccatgaatgtgcacaatctccttgaaaaacaaatcagccacatggcttgcatcatctacctttttgcatgcaatgaaatgtgccatcttggaaaacctatcaacaacaacaaaaatagaatctttcccattctttgttctaggtaaacccaaaacaaaatccatggaaatgtcaacccaaggaaattcaggagttggtaacggtgtataaagaccatgaggcaaaacttttgatttggcctttttacacactatgcatctttcacacaacttttggacatcaattttcatatgtggccaataaaaatgctcttgcagcaactctaaagttttaacaaccccaaagtgtcccattaatcccccctcatgtgcctcttttaaaagcaaacttcttatggaacattttggcacacataatcttttttctttaaacaaataaccattgtgcctaaaatatccattaatggcagctttttacgtttttgcgcataaaatcttgttttcgaatccgatttcagtttcgttttcgccaatgcattcctaacacttagaccatacaaaccacacttgaaaacttgacatttaaagattaaaataacttaatcaaactcatcccaaaatggcttattttgcaaaagcgcttaaaaaccacttttactcaaaaacccgttttcttcccaaaacgatttctctccaaaactaagtgattaaaacaaaaaaaaaatcatatcatcctaattcactctaacgacttccttaactcattcaacatcatcaaaatcaaacttcttcattatcaacccattttacaaaaccaacaacaacaactcatttctcagcaacaatcatgaatcatgcaaacccaagccatgaattatcatcaacaacatgacatatcaacaacaacatcaattgatcatgaaacttatcacaattcaacaacaacaaagcataattcaccaattgagcatattttcaacatatacccttttcatacacttgaaacatgaatttcaaccaacaacaattcaattattcataacttcatacatccaaacatgtcatcataattagagcacgaatttcatcatttatgaacaattaatcaattcacccaattaagcacttttcatacaaataattgaaaattgcaataagtgattatgattaattctaacccccttaccttagtaggttaatctccctagcttaggcttcaatttttctcctagctctctttcaccctttgttcttcaagtcctcttctctctaaccattttctcctcttgctcccattttctctctctattcactccaaaatatcttagtgtaatgaaagtgtgaggaaattactcataagagtatgtttatatagtgtgtctcacaattgggcctaaccctcaacttaatggacttaacccatttctattaaaataaaaatgtttctacactctaaccggtaattaactaataatggtcaagtaacggtaaaatgtcactaacggtcactaaacggtaaaatcttagttttactctaataacttagtaaaataattattctcactaatcactaaaagtaatttccaccaaaaattataattttaccggttctcacaaaatgaccaaaatacccctaaattcaaaatgactaaaatacccttctaacacggaaacccatgaaaatgcaccaaatgatgaataatcacacacaagcacatataaacacgtaataaaagtaattaatataaatctggctaaaaatcgggttgttacactttcttaccacaacggaaacaccgtttcacatcattgatgggaagtgcacagtcttactaaagtagtaatgaaaagagtatcgttctgacaaggagttgtttaattcaattaactttagttggtgattataagagaattaagaatgtaagattgttgttttcaaatggttgaaagagaaaataataataaaagagagccttgggatcgttggtccgtcataggtgacaaaatcattcacaagtcaagccattaaacctaaaccttattttagacctagtttctaaagacgagtttctcttaagcctatcacatctcctatcggtctcagtgagtgtgttcctctagcaagcacgcctattttcatggttgattactattagaatccttgaagatcgaaactctataagtctcaaggttcaatagactattttcatgtttcgcaatccttgtctaaattcacttgatcgaatattaaagctccactttcgttttatgaattaacatttggaatgatggattaacgattatcaaaccctccactttcgtttccacagtttgataatattaaatccatgtttaaacggtgaatttagaacataaactagggttatataataccaaggttgaaggcttgacttgattaggattatgtcattagacttatccaacaatccaaggacataagaagtctactcactcatggtcatcgtagacatggagaagaagagagaaaacataaaagtaaatgacaagaaagtaaaagaaaagaaaagaacttttattagaaagacaattgtcactattgaattccagagaaaagatgaatatttgtgatggctagctactctatttatagtttacattcgacttaaaatctaagcaatcactagaatgttccacaagtaaactaaaatagagtagcttaaaatctaagcaaaagcagcaaaagtagttatggagtgtggcatggccgtgccaagcctagcacgggccgtgccaagtttctaacttgaggaagatatatttttgtctccgaatcttcgtattttcgtaccgaatcagctccaaaacccctttcttttgctccaagactcaatccatcaaatattcgttcctgaaatataacaatatgcaattgtagtaaaatagctcaaaaaggaaataatattaaaataaaataaacttaaatctaattaaaacaaaactaaataacatattaaagtagataataaatgactcatcaaactcccccatacttgaatctttgcttgtcctcaagcaacaggcataaacatggtagcataaacaagattacttcatgacaatttaatcaaaacacatgtctcttcaaaggctttaatttcaagtgtgcactaatcacaaactcaagcattctttgtaatcctttttcaacccaacaatcaagtttcaaatgagtgtgtgtgtatagtccgaacgtgttcctaaaaatatcttactcatacatttactcaagggaagcaacttgtgcatttctcattggagaatttattcattttgaaacaagatgtgggtatatcaagaaaacttaaaacacaagagtttactttcatgtacaagaaataaccaattaagaggagacaataaaaaaattatgtcatgatatttttcaataaaaacaagctacttaaccatgcctttcacaataaaatagaacaaaagaataaagttcaagggagtttggaaacacaacgactcgagacactttattaggctccccccacacttaggagaagcattgtcctcaatgattcaaaataagagaaataaagaagaagaagaagaagaagaagaagaagaagaagaagaagaatgggggaggaggagtaagtgaagaaaggaagaggaaagctcacatttttcattgaggtccatagggagggccttggaggttgaggtgttgcatcatgttccgaagcatttgattattctcttcggtgatgcggttgccccttaggacttcattgcagagtccggataattcaacaccttgcctttgttgctcggtgcttattgtaacaacaaaggctgacgaggacggggagtggtccccggtgcacaaggcacgacaatgagcgactcccgacagcttctagaggaatcgaatcacatcggaatgagaggcatcctgaggccgtgtaggtatgggactacatggttgaaggaaggcttataaaaattgttgggtactacctatatcaacaagatgcatcttcttttcggtagctcattccataagaactccaaagttaagcgtgcttgacatggagcaattttgggatgggtgacctaccgggaaatcggtaagtgtgcgagtgaggacaaaacacgcagaaaagactcgtgttggtttgtggggtcagtcgacaatgctgaaagcagtctgggatgttacactcaatgtcttcactttccgatcatcaatcctcaccagtaaagtctctaccgtaaggttgtctctaacttgcacatcatcactctggatcacatgagatggatccggaacatacttccgaagttgcgacacatggaaaacatcatgcaaagtcgaaagatgcggtggtaatcccactcgatacgccaccgttctaactctttccgatatcatgataactcttttgtcgactctgcgacgctttcattttctcttgaatcatcttaactttctcagtagtctgctgaacaatctctggtcctaagaccactctttctcctgactcaaaccaacacaacggagttctgcatctccgaccatataaagcctcgaaaggtgccattccaatactagaatgataactattattgtatgtgaactcaatcaatggaagatgactatcccaagttcctccttgctcaagaacacaaactctcaacaaatcatctagcgactgaatcgtcctcttcgactgaccatctgtctgcggatgataagccgaactcaatctcaacttagaacccaaggcctcttgcaaactcttccaaaatctagaagtaaatcttggatctctatctgatacaatgctcgaaggaacaccatgcaacttcacaatctccttgaaataaatctctgccaactgggcaacaggaaaactaatattaatcggtagaaaatgagccgactttgtcaatctatcaacaataacccaaattgcgtcattccctctaggagtattcggcaaacacgtcacaaaatccatggatatactatccaatttccactctggcacatctaaagataccatcataccagcaagtttctgatgttcaatcttcgacttctaacaaactaaacaggaatacacaaactgtgccacatcacgtttcaatccagaccaccagaaaatcttctttagatcatgatacatcttcgtagctcccgggggaatacttaggctacttttatgactctcttcaagaatcattttcttcatcttttcatcgtcaggaatacaaattcgacctcggaatctcaacacaccatggtcatcgactttaaagtcaccatcttcagtctgattactagcaaccaacaagtctacaaacttgacatcaactttatgtgcctctttaatactctttagaaattcactgtcaatcttcagcattcccagtttcacactctgcggtgaccgctcacaaactaggctcatatctctaaactgttcaagtaactcgaactctctaaccatcaaggcagatgatgagtcatttattgactatttttatatgctttttagtttagttttatttagattttattttattatatattagtattatttcctttttaggatagtttactacaaattgcattttattttattttaggaatgaatattggatggattgagtcttggagcaaaagaacgggatttggagccgattggatgcaaaaatatgaagattgagagacaaaaatatgtctccccacagtcagaagcttggcacggcccgtgctagccttggcacggccgtaccaccctccagagtgccctttgctgctttttgcttagattttaagctactctatttttagcccaaatgtaattgcttagattttaagtcaagttgttataccctgattttggacctaaaaatactcgttcaaatttcttttccaacactgatatttgtcaattctatgttattttactctgaatctttactctctttttaaacgtattttactgcctctgtcttttctgacattacaagtcatttaagaactctctgaaacgtcgcgttactcttttttgcattttatttcaaaaatcatacaaaagggtattttggtcatttcctgcagtggaactcattttagtccctgtgtttgcctctgagtcttttcaacctgtctgtacgaatcattgtcgagtctttgtttaaaagtcatttcaaaatttgcatttgagtcagtttagtccctaggggcattttggtcttttcctgtcaaaatttcgacagggaggtattttaaaatacctcatgtcagtaattggttcgttttagtccttttgttaattttatttttggtttcgctttacgtttcgtcaaatttactttttagtccaattttatttttaatcacgttttggtccaaaacttttaaaaatttcattttagtccattttttattgctgtccagtccttcaagttttttattttgcagaaaggtcccaggggcattttagtccagattttcgatccacatcaatcccaaaccagatgtcattttttcattggttctcagatacacatggcaggctataaatagtaaatgtgtcagatccatcacaaggagtcagaaaaaatcagaatcaatcacaatcagtctcaaacagaatctttttctctctctctcatccataacataatcaaaacagaaaaatctcagaaaaaaagaggaagaacaccaagaacacatcatcaccaaaatcaacagatctaaaccggatctgctcagaatcaactccggccaccaccaccacttagctcgccggcggcgagtttctagagagaagagagagcatttttgtgattttgagttttagagagagaaggagaagaggtttatgtgttttttgtgtgaaaattcctttatatactccctccgttcccacgcgcgcgcgtgcatgtttctgtggtgttccttcgctctgtggaccatcagatctggattgttccaagatctgatggctgctgtgtgtttgattttgaatactgtgtgtgattttttgtgtggaatatgttatatcttctgtttgaaccgttagatctttgatctaacggtcattgtgcttcctgcaattttacactatcttttttgtgttttttgcccttggatctttgatccagtggctgtgatgagatcttgggagttagatctggacctctggattcatccaacggtccagattataacctgctgagttttttttaattgctttttttgttgtgtttttaaatacttttttacactttcttggcattttatgctcctaaaaattttctaaaaatgtttccctatcattttaattttttctctaaatgttagaatttacttgcttatattttctattttcttcatttgttctttttaattcttgctcattaaattcctatatgttcttggtgcattttttgacattttgtgatttttttttttttttttacatgttaaataatgtgtagaaaatatccctaggaatatggtatgatgctttgcttgtgtgtttttatgatcctcacattgtagcttaaaatcaaatctcttttaaaaatggttatgatgagggaattataagccatatgcatgtctaagtgtcataaccaattttaggtatattttgccattttatttcatttcattactctttttttctcttgctattctattcaattttgtttacctttctactatttttatgccttatgatactaaccatttcatctcacatttcattcatcccatagttttggcatcatttttctattcatttctatatcaattgggtttataataattttagatagattagttctttttttaaattccttgcaagaccatagcatgtatttagaactcaatgtaaaggactatggacactataagggatgtacaccgacacaagcaccgacacgcacacacgttgcatgtttaccgtttagatgtatgcttaggaaacgcgattttttagacaaatgccaattttcaaaaaaaataataaaccaattccatcactcaaatttttccaaacaaaccttggagtcaaaactccattgaatttcttcttttattttcttaaacaaatccaaatgaatcctaatttctacttagactttttaataacaattgaaccaaccattcaccatttttctctcttatgcctttaaggcctcttcctcttcttcaaaaccactttccaacaaaaactaaaatcaaccaaacacacaaaaaaacattttttgagagagaactacatggagtttgatcccttaaatgggtatgtaggcatgaggtcaaaacctctccaagtccactaaaataaaacctcaaacactttctcccccccattcttaacataagtaaatttcctttttcataaagtagcattaaaaataaagtgtagacataaactaagaaaacggctcctatagagtactatagtcaccgcgggtgcctaacaccttcccgtagtgaaaacgacccccgaacttcgaatctaagggttttttctcaattttgcccttcccaagaaaaaatagagaatatcaaagattgaaaggttcaagcctaattaatgacttgacacccgaaaatcgcgataacagaaatggcgacttcactggggaatatttttagcgggtcacgcctagttttccttagtttatatttatgctttgttttattgcttacatatatgaatacttgtttattttcatttgacgtgtggggtgagaatatcaaaagtcctatacccgggctgagtgaacttatgaataggtagagatataatcgacaattcgatccgagggttgcctcgtgtattgggttatgcgatcaatctcacatagctgaggcattttggaagtaatattgtcggcgtgtgttgtcatgcttaggcactttgctttcaattgttcgacgatgctatggaccgtagttaccaaacccatccctggcctttttaggacgtagtgcggtggctaaaccgagtgttgtctcgagttttagtcgtcacgcgatactacactcaaactagaccttcttgcgaataaacatggaacggacgttgtcccgtgctaccatgatatacgtaagagaggttgcagtttgggaacttgattagaaccttggttactattatcctaaaatttagtttaccgggcaccgtgtccgcccgtggctcctcggctttaatctcaacccttcatgttttctctgtaattgaaaaaaacaatcatgcataaatttttcgcatgcattcatcgaaggattggacaaattaaaaactttgtaaacattacaggtatgaagaagactaaatcctacaagttcaaggaggttgatttggttagtttgagagatttggcactaaaggtgaagaatcaaacgggtttccgactccggtatggtggtttgcttactattctccggactaatgttgaagagaagctcgtgcacactctagtgcaattctatgacccgagtttccgctgcttcactttcccggatttccagttggtccctactcttgaggcttattcccacttattggattcacctatagccgagaagacgcctttcaccggtcccggggcttctcttactcctctggtcattgccaaggatctctatctcaagacttccgatgtctccaagcatcttactactaagtctcacatccgagggttcacttccaagtatctacttgagcaagctaatctcgaaactacttgtcaggacgcactcgaggctattcttgcattgcttgtctatgggctcattctcttcccgaatctcgacaactttgtggacatgaatgctattgagatcttccattctaggaatccggttcctaccttgctagctgacatgtaccatgctatccatgaccggactctcaaaggtcgtgtgtatatcctttgctgcgtgcctctcctatataggtggtttatttctcaccttccgagctccttccatgacaactcggaggattggtcctactcacagcggatgatggctctctctcctaacgaggtggtctggatcactcccgccgctcaggttaaggagattattactggttgtggagactttctcaatgtacctcttcttggtacccgtgggggaatcaactacaatccggagcttgctatgagacagtttgggttccctatgaagacaaagcccatcaatcttgctacatctccggagttcttctattattcgaacgcccccaccggacaaagggaggctttcacaagggcttggtctaaggtccgttggaagagtgtgaagcatttgggtgtgagatctggtattgctcatgaggcctatactcagtgggtaataaaccgagccgaagagattggtttgccgtaccctgctatgagacatgtggctgcatctgctccatctatacctttacctctacctcccacaactcaggagatgtatcaggagcatctggccatggaaagtcgtgagaaacaaatgtggaaagcccgatacaatgaggctgagaatctaatcatgactttggatggtaaggatgagcagaagactcatgagaacctgatgttgaagaaggaattggttaaggtccgaagggaacttgaagaaaaggatgagctacttatgcaggactccaagagagctagaggacgacgcaacttctatgctagatactgcggttcggattcggagtctgagtctgaggatcatcccaccacttcctatgcttgagagttttattcgtttatatttcaaagtcttcccttggcttagtatttcaaaggggttcatcttgtaaacacttcgttttgctttgtttgtttagatattgtttacaaaactcctaatttgtctaaaaatccttcgatgtccaaaaaaaaaaacttttgcatttgcatttgtacatatcatgcatcatgtgcatcattcatcaagccacaaaaggtttccaagtgctcactgcctcctggttcttctgccacagattgaaaggtggctcgtgctcggaaagtttacgaatcagacagaatacaccggactagactctacagaaagaagaattcggtagccatggaagaagaaaatgctcagctccgtaccgagttagccactctaagggaagaattggctaaggctaatgatgtcatgactgctctgctagccgctcaagaacaatcagccacggctatccctatagccacagctataccggtgactacaagcgtgctcccaactgcatctacagacgctcgcttcgctatgccagctgggtttccgtatgggcttccaccgttcttcactcccagtactgcagcgggcacttcgggcactgctaacaatgttctgatccctgcaacaaatgttgtctccatcaatgctactttgccacaaacaacggcagctgtcactgagcctcttgtgcataccatgcctcaaagtgttaacatcaacacacagcacggaagcatccccgtaaccaaaaccatggaagagatgatggaggaacttgctaaagaactccgtcatgagatcaaagccaatcaagggaatgcggactctttcaaaactcaagatctctgcttggtgtcaaaggtggatgtccctaagaagttcaaaatcccagatttcgaccgatacaacgggctgacttgtccccagaaccacatcatcaagtacgtccgaaagatgggcaattacaaagacaatgattcccttatgatccactgcttccaggatagtttgatggaagatgctgcagagtggtatactagtttgagcaaaaatgacatccatacctttgatgaattagccgctgccttcaagagccactatgggtttaacattcgattgaagccgaacagggaattcctcagatctctctcctagaagaaggaggaaagcttccgtgaatacgcacagagatggaagggggcagctgcccgcattactcccgctcttgatgaagaagaaatgacccagacattcttaaagaccttgaagaaggattatgttgagagaatgatcattgctgccccgaataacttttcggagatggtcaccatgggaacccgtctggaggaagccgtcagggaaggaatcattgtgttcgagaaagctgaatcctctgtgaatgcatcaaagaggtatggtaatggacaccacaagaagaaagaaacggaagtagggatggtgtcagctggagctggtcaatccatggctactgttgctcctatcaatgcagcccaaatgcctccgtcatacccatatgtgtcgtattctcagcatcctttctttccgccattttatcatcagtaccctctgccaccgggtcaacctcaagtacccgtttatgcaatcgctcaacagatgaaacaacagttgccagttcaacaacaacaacaaaatcagcaagctagacctactttccctccgataccgatgttgtatgctgagttgcttccaacattactccatagagggcattgtacaaccagacagggcaagcccgcacctgatccgttgcctccaaggttcaggtccgatctcaaatgcgattttcatcaaggcgctctgggtcatgatgtcgaggggtgctatgctttgaagtatatcgtgaaaaagctcattgatcaaggaaagctgacttttgagaataatgtcccacatgtcctcgacaatcctcttccaaatcatgccgctgtaaatatgatcgaagtatgtgaggaagctcctagacttgatgtccgtaacgtcgcaactcctctggtgcctctacacatcaagctgcacaaagcttctctgttcagccacgatcatgccaagtgcctaggatgccttcgtaatcctttgggttgctataccgttcaagatgacatccaaagcttgatgaatgataattttttgactgttagtgatgtctgcgtgattgtgccagtttttcacgatccgcctgtcaagagtttgcctttgaaggagaatgctgagcctctggtgataaggttgcccggaccggtaccgtatacttcagatagggctatcccgtacaaatataatgctaccataatcgaaaacggagtagaagtgcctctggtgtccttggctgtgatgaacaataccgccgaaggaacttcaacagcccttagaagcggaagagtccgtccaccgttgtttcaaaagaaggcagctacgcctactgtgccacccattgacaagccaaccccgactgatgtttctcccgttaacagagacgcgagccaaccaggccggtctatagaggattctaatctggacgagattttgaggttgatcaaaagaagtgattataagattgtagatcagctgctgcaaactccgtcgaagatatccattttgtctctactcctgagttccgctgcccacagagatacccttttgaaagtattggagcaggcttatgtggatcatgaagtcactgtggatcactttggtagcatagtggggaacattaccgcctgcagcaacctgtggttcagtgaagatgaattgcccgaagcaggaaagcatcataatctggccttgcatatctctgtgaattgcaagtccgacatgatctcaaatgtgttagtagacactggctcatctttgaacgtgatgcccaagtcaacgctggatcagctgagttaccggggaactcctttgaggaggagcacttttctggtcaaagcctttaatggaacccgcaagagcgttctcggggagatagacttgccaataactatcggtcccgaaacctttctcatcacctttcaagtcatggatattaatgcctcttacagctgtctcttggggagaccttggatacatgacgcgggtgcggtgacctctactttgcaccaaaagttgaaatttgcaaaaagtggaaagcttgttaccattcatggagaggaagcatacctggttagccagctatcatctttctcttgcatagaggcagggtctgcagaggggaccgcttttcaaggattaactgtcgaaggtacggagcccaagagggttgggactgccatggcttctttgaaggatgcatagagagccgtccaagagggccaagctgccggctggggcaggttaatacagcttcgtgagaacaagcataaggaaggtcttggcttttccccaacttcaggagtttccaccggggcattctatagtgctgggtttgtcaacgcaatcacagaagaagcaaccggatttggcccgaggcctgtatttgttacaccaggaggcattgcgagagattgggatgccattgacattccctccatcatgcatgtttctgagtaatataccttgttgcttaagtatcttgtttttttcaaaataacaatcctctcgctctgcccaaagcgagagtgatattttctgtaagggcatgtttgtttcggcattgccgttgattaataaaaaaaattttgtcgtttctttcacgactgctttttagtgccttttttcttggaaataatggtaatgccagaaaaaaccaaaacatctgtatttttcttattaatttcaaaaatctgcataaaaaccctctttctaaaatcatccaaccattttacgcagattgaactataataaacccgttgggcacagtaaccctgcattccctccgaattttgagttcctagtgtatgaggccgaagatgaggaaggtgatgacataccatatgagatcactcggttacttgagcaagaaaagaaagccattcagcctcaccaggaagagattgagcttatcaacataggtaccgaggagaacaagcgagaaatcaagatcggtgctattctagaggaaggggttaaaaagaagatcatccaactcctccgggaatatccggatatttttgcatggtcgtatgaagatatgccaggtctagatcctatgattgtagagcatcggatccccaccaagcctgaatgtcctcccgtcaggcagaaattgagaaggactcatccagatatggctctcaagattaagagtgaggttcaaaaacagattgatgcgggtttcctcatgacagtttagtaccctgagtgggttgccaatattgtacctgtgccaaagaaggatggtaaagtccggatgtgtgttgacttcagagaccagaacaaagccagtccaaaagacaaatttccattacctcatattgatgtgctcgttgataataccgctcagtctaaggtgttctccttcatggatggtttctccggttacaatcagatcaaaatgtctcctgaagatagagaaaagacgtcttttatcactccatggggtaccttctgctacaaagtgatgccattcggcctaataaatgctggtgctacctaccaaagagggatgactactctctttcatgacatgattcacaaagaagtcgaagtatatgtggatgatatgattgtgaagtcaacagatgaggagcaacatgttgaatatttgacaaagatgttcgaaaggttgagaaaatacaagcttcgattgaatcccaacaaatgtacgttcgacgtcagatccggaaagttattaggcttcattgtcagccaaaagggcattgaagtcgatcctgataaagtccgggccatccgagaaatgccagctccacagaccgagaagcaagtcagaggtttcctcggacgtttgaattacatctcccgattcatatctcatatgaccgcaacctgcgggccgatcttcaagctgctcagaaagaatcagcctattgtatggaatgatgaatgccaagaagcttttgatagcatcaagaattacctgctggaaccacctatcctcgtcccacccgtggaaggaagacctttgattatgtatttggcagtatttgatgaatccatgggatgcgtacttggtcaacaagatgaaactggaaagaaagaacatgctatctactatctaagcaagaagttcaccgattgtgaaactcggtatacaatgcttgagaagacttgttgtgctctggcctgggccgctaaacgcctgcgtcattatttggtgaatcatacgacttggttgatatccagaatggatccgataaagtatatctttgagaaagccgctgttactgggaagattgcacgttggcagatgcttttgtctgaatatgatattgtgttcaaaactcaaaaggcaatcaaaggtagcattcttgccgatcatcttgcttaccaacctcttgatgattatcaaccaattgagttcgatttccccgatgaagagatcatgtatttgaaatcaaaagactgcgaagaaccgttgattgataaaggtccagatcccaatagcaagtggggtttagtctttgatggtgctgtcaatgcttatggtaaaggaattggggcagtcattgtatccccgcaggggcatcacattccttttaccgcccggatcctgttcgaatgtacaaacaatatggctgagtatgaagcatgtatctttgggatcgaggaagcaattgacatgagaatcaaacacctcgacatctatggagattctgcgctcgtcatcaatcagataaagggtgaatgggagacccaccatgctaagttgattccttatcgtgattatgcgagacgactgctgacatattttacaaaggttgagctgcaccatattcctcgtgatgagaaccaaatggctgatgctcttgctactctatcctccatgtttcgagtaaaccattggaatgatgtgccaataatcaaagtgcaacgccttgaaagaccttcacatgtgtttgctattggggatgtgatcgatcaggctggtgaaaatgtggttgactataaaccttggtactacgacatcaaacagttcttgctaagccgtgagtatccgtcgggtgcttccaaccaagataagaagaccctgagaagattggccagtagattcctgttagacggagatattctgtacaagagaaactatgacatggtattgttaagatgtgttgatgaacatgaagcggagcagttgatgcatgatgtacatgacggtaccttcgggacccatgctacagggcatactatgtcaaggaagttgttacgggcaggttactactggatgaccatggagcatgattgctaccagcacgccagaaagtgccacaaatgtcaaatctatgctgataagattcatgtgcctccgcacgctctcaatgttatttcatccccatgaccgttttcaatgtggggcatcgacatgattggaagaattgaaccgaaggcttcaaatggtcatcgtttcatcttagtggcaattgactacttcaccaagtgggttgaagcagcatcttataccaatgtgaccaagcaagtggtggctaagttcatcaagaacaacatcatctgtcgatatggtgttcccagcaagattattaccgacaatggtaccaacctgaataacaatgtggtgcaagctctttgtgaagaattcaagattgagcatcataactcttctccttatagacctcagatgaatggtgcagttgaggccgccaacaagaatatcaagagaattgtccagaagatggtaaccacttacaaggactggcatgagatgttaccctatgctctgcatggctaccgtactactgtgcgcagttcaaccggggcaacccctttctctcttgtatatggtatggaagcagttcttcctttggaagtggagatcccatctctccgtgtgatcatggaagcaaagttatccgaggctgaatggtgccaaagccggtatgatcagttgaatttgattgaggaaaaacgtatggatgccatggctcgtggacagtcatatcaagcaagaatgaagactgcctttgacaagaaagtccatcctcgagaattcaaggtaggggaacttgtattgaaaaggaggataagccagcaacctgacccaaggggcaagtggacgcctaactatgaaggtccttatgttgtcaagaaggccttctccggtggtgctttaatccttacacacatggatggtgtagaactcccaaatccagtgaatgccgatatagtcaagaaatactttgcctagaaatgtgaaaagaacagcgtggtaggtcgaaaacccgaaagggcggcctaggcaaaaatgcgcttcccggtggatcgaaaacccgaaagggcggtccaggcaaaaataagggacaaaaaaaatatatgaaaaagctcgctgagattgtacacaactcaggcaagaatgagcgtctcgatgaaccgaaaacccggaagggcggttcatgcaaaaatgagattgaaacaaaaggcaagtaactatatctggttaaccaccgtctcccttggggcatctgcagctgttaatgaccatcttcatcaaaagcccctacgcttgcgaattcaaagttcctaggaaatgtcatgattgctgtgttcaatgtaccaccaaccaataaaattaccattttccaagctttgtaaatccgtggagtcacgccttcggctgaccaccaactcttatacatcaattgaagcctgtgcttttgtttgaaactctgctttctctttactttcaaagttatgtacaaaaacatttcccttctatttttaataatgacaaatgctcgaaacaaacatcttgaaaattgaaaaagtttttgaaaagcaaacctgagcaacagggtacattcaaacgaacatgcatgagcgagtgtatgttggtgcctatttcaatatatgttacaagcaggttctcctccaggatagtctgtgttcaatggcaagaatgaaaaaaacagaatgaaaatgcatgaaaatgaataggctcgctaagttgaaaacccggaagggcggcttaggcaaaaatgagcaccccgctagattgacaacccgaaagggcagttcaggcaaaaatggggcattgaaaagaatttatttccccgatggatcgaaaacccgaaagggcgatccaggcaaaaatgggatgcaaaaaaaaatgaatgatggaaaattgagaaaataacatgcaaaaagcattgaccacagatgcgacgtccacgatacatccggcattattcccagtagagtctcccgagattctatccccagcaagttgcatagctacctgccctcagccatggtcccgatacgtctccaaagaggatttccaggaatgtgtaatatagcacgagccactacgtgcccaatactccaatgtcttgtatgtctttgcgaaactgtgtctacaaatcgccaacagtcatgcattacaagcattcatacatgcataatcatgcatattacgtgcccatgcatttaatgaaattgttatatcattcatgcatattgcatttccaatatcaatatcagtctcaactcaatactcatgtcgggttctctgtcaaaaccttgtgagccaataatatcggtcaatttctacctttcaaatcaaatcgacgtcaagtcaatttcaacctatattttgtcaaaaaaactaatcccctgtgaatttgtttctgttcggtcaagtggctagttcaagtccaagaacagcttgtacctatcaatttgcttatgttatcggtcgagtgcccagctcaatccaagagcagcttgtacctgtcaatatgtttctgtttggtcaagttaccagttcacatccaagaacgacttgtacccgtttacttttcaatgttatcggtcgagttaccagttcgaatccaagaacagctcgtacctgtctatgtgtctatgattttggtcaagtggctagttcaagtccaagaacagcttgtacccgtctatctgtttctgttcgctcaagtggctagttcaatccaagagcagcttgcacctgtctatttgtctttgtctccggtggagtaaccagttcgcatccaagaacaagctcgcacctgtctatttaccttgctttcagtcgagtgactagttcgaatcaagaacaactcgtacctgtctaccttttctatgtctccggtcgagtgaccagttcgaatccaagaacaactcgcacctgtttgtctgcttttattccaggtcaagtgcccagctcaatccaagagcagcttgtacccgtcaattcgttcctagtctcctatctaccctgttatctgttatcgtgccaatgtctaccaatcccgcaatggatacgacatcttttgttaattccaactttcgtttgtctcgcactcataatccaaatgttgcatggcattcatgatatttgaaaatgtacaagcgtatttttacgtccaaacacagtgcaaatgttaatatttaagtatcttcgtcccgtcaagccaaagactctgtctcttgaccctccagacaaagaaacttaaataggggcagctgttataccctgattttggacctaaaaatactcgttcaaatttcttttccaacactgatatttgtcaattctctgttattttactctgaatctttactctctttttaaacgtattttactgcctctgtcttttctgacattacaagtcatttaagaactctctgaaacgtcgcgttactcttttttgcattttatttcaaaaatcatacaaaagggtattttggtcatttcttgcagtggaactcattttagtccctctgtttgcctctgagtcttttcaacctgtctgtacgaatcattgtcgagtctttgtttaaaagtcatttcaaaatttgaatttgagtcagtttagtccctaggggcattttggtcttttcctgtcaaaatttcgacagggaggtattttaaaatacctcatgtcagtaattggttcgttttagtccttttgttaattttatttttggtttcgctttacgtttcgtcaaatttactttttagtccaattttatttttaatcacgttttggtccaaaacttttaaaaatttcattctagtccattttttattgctgtccagtccttcaagttttttattttgcagaaaggtcccaggggcattttagtccagattttcgatccacatcagtcccaaaccagatgtcattttttcattggttctcagatacacatggcaggctataaatagtaaatgtgtcagatccatcacaaggagtcagaaaaaatcagaatcaatcacaatcagtctcaaacagaatctttttctctctctctcatccataacagaatcaaaacagaaaaatctcagaaaaaaaagaggaagaacaccaagaacacatcatcaccaaaatcaacagatctaaaccggatctgctcagaatcaactccggccaccaccaccacttagctcgccggcggcgagtttctagagagaagggagagcatttttgtgattttgagttttagagagagaaggagaagaggtttatgtgttttttgtgtgaaaattcctttatatactccctccgttcccacgcgcgcgcgtgcatgtttctgtggtgttccttcgctctgtggaccatcagatctggattgttccaagatctgatggctgctgtgcgtttgattttgaatcctgtgtgtgattttttgtgtggaatatgttatatcttctgtttgaaccgttagatctttgatctaacggtcattgtgcttcctgcaattttacactatcttttttgtgttttttaaacccttggatctttgatccagtggctgtgatgagatcttgggagttagatatggacctctggattcatccaacggtccagattataacctgctgagttttttttaattgctttttttgttgtgtttttaaatacttttttacactttcttggcattttatgctcctaaaaattttctaaaaatgtttccctatcattttaattttttctctaaatgttagaatttacttgcttatattttctattttcttcatttgttctttttaattcttgctcattaaattcctatatgttcttggtgcattttttgacattttgtgatttttttttttttttttacatgttaaataatgtgtagaaaatatccctaggaatatggtatgatgctttgcttgtgtgtttttatgatcctcacattgtagcttaaaatcaaatctcttttaaaaatggttatgatgagggaattataagccatatgcatgtctaagtgtcataaccaattttaggtatattttgccattttatttcatttcattactctttttttctcttgctattctattcaattttgtttacctttctactatttttatgccttatgatactaaccatttcatctcacatttcattcatcccatagttttggcatcatttttctattcatttctatatcaattgggtttgtaataattttagatagattagttctttttttaaattccttgcaagaccatagcatgtatttaggactcaatgtaaaggactatggacactataagggatgtacaccgacacaagcaccgacacgcacacacgttgcatgtttactgtttagatgtatgcttaggaaacgcgattttttagacaaatgccaattttcaaaaaaaataataaaccaattccatcactcaaatttttccaaacaaaccttggagtcaaaactccattgaatttcttcttttattttcttaaacaaatccaaatgaatcctaatttctacttagactttttaataacaattgaaccaaccattcaccatttttctctcttattcctttaaggcctcttcctcttcttcaaaaccactttccaacaaaaactaaaatcaaccaaacacacaaaaaaacattttttgagagagaactacatggagtttgatcccttaaatgggtatgtaggcatgaggtcaaaacctctccaagtccactaaaataaaacctcaaacactttctcccccccattcttaacataagtaaatttcctttttcataaagtagcattaaaaataaagtgtagacataaactaagaaaacggctcctatagagtactatagtcaccgcgggtgcctaacaccttcccgtagtgaaaacgacccccgaacttcgaatctaagggttttttctcaattttgcccttcccaagaaaaaatagagaatatcaaagattgaaaggttcaagcctaattaatgacttgacacccgaaaatcgcgataacacaagtgtatgctataaatagagtagccatccatcacaaatattcatctttacttggaatacaataagtgacaattgcttttctaattaaagttcttttcttttcctttattttcttgtcatttacctttatgctttctcacttctcccccatgtctacgatgaacatgagtgagtagacttctccttgtcttgggattgttggataagtctaaatgacataatcctaaatcaagccaagctctaagccttaatcttatgtaaccctaatttcttatctaaattcaccactttaacatggatcaaccattatcaaactgtggaaacgaaagtggagggtttgataattgtttatccattattccaaatatcaattcataaaacgaaagtggagctttgatattcaaacaagtgaatttagacaaggattgcaaaggcagcgaaatagtctttgcaatctttgagacatatagtttcgatcttcaagggaactaataacaatcaagtcagcgaaataggcttggttgttagaggaaccaaaatctaatagtaatcaagtcagtgaaatatgcttggttgctagaggaacataagagaaactgtcttgagaaattaggtctaacataacattataagcttttagtttggtttgtgaaggacttgttatttagatgaaaccaacgatcccaaggctccttttattatattaattttcattcgtttgaaaacctcaaacttacaattctcttcttctctaatcatttccaaaggttaattgaattaaactactccctgtcggaacgatactcttttcatactacttcggtaagaccgtgcacttgcggttttatctcatcaagtttttggcgccgctgccggggagtaaactaacttaattaactctttctttgtgatcagaactccttcttcttcctcttttcttctacttctttctttgtattaccaattaacttcttgggttctcgatttcttatgcgaagaagtaaaagtctcggagaatttattcctgagatcgaaagatatttgcataagaaaaagagagaggcacaaaataatactgctaggctgaacgcactctcaaagagtatgctactccttcaactaaagagccacaagctattatcgtgtacccaacggttgagggtaacaacttcgaaatcaagcctgcactactcaattttgtgcagtaaaatcagttttctggatcacccactgaggatccaaatctccatatttcttccttccttagactcagtggcaccataaaagagaaccaagaagccgtaagacatcatctctttcccttttccttaagggatagagctagcgcttggttccattccctagaagtcggttccatcacttcatgggacgatatgaggcgagcattccttgcccgatttttccccccatctaaaaccgctaaactaagagatcaaatcacgcggttcaatcaaaaagatggggagtctctttatgatgcgtgggagcgtttcaaggaaatgcttagactttgtccccaccatggcttggaaaagtggcttgtagtccacaccttttataatggcttgtcatataccactaagatgtctgttgatgcagctgcaggcggagctctaatgaacaaaaattatacggataatggctcaaaatcactaccaatggaccaacgagagagtcatcaccgcttctactccctctaagaaagaggcaggtatatacgaagtctcagaatataaccaccttgctgctaaggttaaggcattaacccaaaattttgaaaaacttaatgttaatgctgtcacaccttcttctgcatcccctccttgttaaatttgtggtatatccggtcatatcggtgttgattgttagttaggtagtgctgtcaatattgagcaactgaattacgctcaatataactaaggaacgaggccaaatcaaaatttttacaaaaatcctcaaggttcctatggacaagcagcaccaccttgctatacaaacaaccagagagtggctcagaaatcaagtttggagattttgttggaaaattgcatagctaatcaaaataaaaatcttcaagaattgaaaaaccaaacgggatttctgaacgactctctctccaaactcactaccaaggttgattttatcgccacacacaccaaaatgcttgagacccaaatctcccaagtggcccaacaagtggccacctcttcgcaaacaccaggagtctttccttgtcaacctgaaacaaaccccaaggctcatgtcaatgctatttttcttgggggtagtaagttagaagagaccgttgctagagccaaaagtgtcaagtgagagagtgttaagcttctaggtaagaaaggtgcgatagaaagtgagaaaccgcttgatgagaacaaagcccttacaccattaaggcttattaagcttaacttggaggctcaattcactaaattcttaaacatacttaaaaagatttgcattagagatctaggaagttttgccatcccttgtatgatagggagtgaaaccttaaatcgagccttatgtgatttaggagctagtgttagtctgttgcccttacccctctttaaaaggctgggaataggggagttaaagcctactgaaacaatattgaagttagccgatcgttctgatatccaacctgtcagatatgttgaggacatccccgttaaaatagaagggatatacatcccaactgatttcatggcgcttgacatagatgaggacaatgagtgccctataatcttaggacgaccctttctcgccattgtgggtgctatagtagatgttcagaatggtaggattgtttttcaagtgagtgatgagctgatagggtttgagttggagaattatatgaaaggtcccgctctctattcttgtaacgtgattaaagttcatgatgtgaaagaacgctcattagcgtcatctacacaatatgacctttttgatcccttctaaggacactttcttttaacgtcaagctaatgactataaagaagcgcttcgtgggaggcaacccacgcatttaactgcttttgttttgttttgttgtttgtttttaaatgttttgtaggtaattgtccgagtatgattcgagaaaacggagaaattttgaagccaattcatccagaaccttggcacggttcgtggtcacactggcacggccgtgccagactttgccttccaaaaaactagtccacatccagaaagttggcacggcccgtgctaaggttggcacggccgtgcccgatcctagatttagttttacctcacctttcatcttcttcatccttcattctccaccacaaacatctctctacattcaaacttctctcaaaaacctccataaccatagaaacttcaaacctccatatctccctcaaaacctcaccaattcacaaaattccttcacctaatcaaccacaatccacatttccatcataacccttcaatcaaaaacaactttcctctatccctaccaaaaatcatcaaattcgtagcccccattcacctacctaaaaacccacaaattcttcaccaattcacccaacccaactcctaacacttactcaaaccccaaccccatcacccaaccaaccttttccaccaaaaacatttcccaaaacctaaccttcacccacaacacaaaaggtcaaccaaggttaaggataatggcatctaggaaaggtggagcaagcttttccggaggaccacaatcaaagaagaaaacgcaagccaagaatcatggaataatcttcaaggacaccaagcaaagggacaggtataaaattcttctctctaaacctttgcacccttgtcgatatcctaatccttatactttaagtgtgctaggactaagggataatgtgtttagcttactaggaaatttaggatgggttgatatgcttagacctatgaaaggttttgaaaatttcacttatgaattcttaagttctattgaatttacgaaggataaagtgaactttgataaccccgaccatagagtctccttccgacttttgaatatggattacgagatgtctcttgaaattttttgtttagagatggacttcgcaaacgcggggttcatccacgactcttggaatccaaatctaaagtcggaagactatgaccccgctctcttttggaaacgcattaccgggttaaggcattataatcctcgcaacaataaggctagaaacattcacaacccagtgcttagatacctccagagagtcatggcttgtactatttggggtagaaaagaggtaggaacaactaggacggatgaactttttatgctttgggcaatgcttagtaacaatcccgttaatacttgcttctacctacttgattacctttcctccataggtgctagaccggataatagagctgagatagtagtcggtggtatcattaccttcatcgctaggaagtttggagtgggtgaggaagatgggataaatccaattgagggcaacaataggcttaatattgaaaccctttttgctatgaatttcattaagattcacccacccatgacttatgcacttcaacttcgtatacctcttttgtttctacttcctaacccatctcggactaaccccgaggtggaagaaaatttgttgtatgttggtgatggattacaagtacatgaagagcataatcaaggtgacgaagaaggtgcacacatgcaccatgaagaggagccccatgaccataacgccgacaatgaaagatgggcatggatgcaagccgaggtacaaaggataagcaccgagcagcaaaggcaaggtgttgaattatccgggctaagaaatgatgtcctaaggggcaaccgcatatccgaagaaaataacaaaatgcttcggaacatgatgcaacactgacctccaaggtcctccctatggacctccataaaaatgtgagctttcctcttcctctttttcaccttatctcttcaatctctatcttgttcttctccttcttcttttttcttctatcttgaatcattgaggacaatgcttctcctaagtgtaggggagcctaataaagtgtctttagtcgtagtgtttccaaactcccgtgaactttattcttttatttcgttttattgtaaaaggcatgaataagcagcttgtttttaatgttttattaggacataaattttttattgtctcttcagtggtcgtttcttgtacatgaaagtgatttcttgtgttgtaagtattcttgctatacccacatcaagttttattgtgaaaattctccaatgagaatagcacctagttgcaatccttcagtaagtgtatgaatcggtattttaaggaacacgttctagctttaatggtaacctggacccttaaaaatcttcagagtaaaagtagtataagtttgtgtgggaataattctaatgtgatgaaatgtgtaaaccgaaatggggcagaaggatatcaccagcacgtggaggaaaagataccctctcactgacttcctaaatgtggtgatgacttctcaaacaaattgtgcttaaattaaacactctaaaaagaggaacttcctaagtgaagtaaacaagttgtagcactacttagggtgatcatagaaacttggaggaaaggataccccctcacggacttccaatgtgaaatgatagcccctaggcatgtacaagcccccaaatgtataaattcatcaaatctatcttaactctcccacctctcttatatgaaatgaagaaaagattttctcggtcattttagtgttaaggttagaacctgctcctcataatatctatcttatacaggagcaagaaaagggttggactacacacacacacactcacttgagatttgttgttgggttgaataagtttacaaggaatacttgaagttgtgattagtgtacattgaaatgagacctcgagggagacataagcttttatttaaattgtcatatattaatccttttgttgctgccatgtctatgccttttgcttgaggacaagcaaagattcaagtgtgggggagtttgatgagtcacttattgactatttttatatgcttttaagtttagttttatttagattttattttattatatattagtattatttcctttttaggatagtttactacaaattgcattttattttattttaggaatgaatattggatggattgagtcttggagcaaaagaaagggatttggagccgattggatgcaaaaatatgtctccccacagtcagaagcttggcacggcccgtgctagccttggcacggccgtgccaccctccagagtgccctttgctgctttttgcttagattttaagctactctatttttagcccaaatgtaattgcttagattttaagtcaagtgtatgctataaatagagtagccatccatcacaaatattcttctttacttggaatacaataagtgacaattgcttttctaattaaagttcttttcttttcctttattttcttgtcatttacctttatgctttctctcttctcccccatgtctacgatgaacatgagtgagtagacttctccttgtcttgggattgttggataagtctaaatgacataatcctaatcaagccaagctctaagcgttaatcttatgtaaccctaatttcttatctaaattcaccgctttaacatggatcaaccattatcaaactgtggaaacgaaagtggagggtttgatagttgtttatccattattccaaatatcaattcataaaacgaaagtggagctttgatagtcaaacaagtgaatttagacaaggattgcaaaggcagcgaaatagtctttgcaatctttgagacatatagtttcgatcttcaagggaactaataacaatcaagtcagcgaaataggcttggatgttaaaggaaccaaaatctaatagtaatcaagtcagcgaaataggcttggttgctagaggaacataagagagactgtcttgagaaattaggtctaacataacattataagcttttagtttggtttgtgatggacttgttatttagatgaaaccaacgatcccaaggctccttttattatattaattttcattcgtttgaaaaccccaaacttacaattctcttcttctctaatcatttccaaaggttaattgaattaaactactccctgtcggaatgataatctttttatactacttcggtaagaccgtgcacttgcggttttatctcatcagcggacatatgcaatgtcttcctactcaaggcatctgcaacaacgttagcattacctggatgataattcaaaccaaagtcataatctttcaataattcgagccaccttcgatgcctcatattcaattctttctgatcgaacaaatactttaagctcttgtgatcactaaacacctcaaacctcgaaccatacaagcaatgtctccatatcttcaatacaaagaccacaaccgccaactctaaatcatgcgtcgggtaattcttctcatgaattctgaactgtcttgaagcataagctaccactttaccatcttgcataagtacacctcctaaacccaacttggacgcatcacagttgttatctcgattttggggtatcaagtcattaattaggcttgaacctttcaatctttgatattctctattttttcttgggaagggtaaaattgagaaaacccttagaaactctaagttcgggggtcgttttcgttacgggaaggtgttaagcacctgtaacgactatagtattctataggaaccgctttcctagctttatgtctacgctttacttttatgcttatttattgaaaaagagagtttatttaggttaaggatttggaaagaaagtgtatgagatttcattttattggacttggacaggttttgacctcttgcctacatacccttttaagggatcaaaattccatgtagttctcttccaaaagtatttttggtgtttcaattgattttagtttttgaaaatggttttgaagaagagaaagaggccgtaaaggcatgagaggaaaagatattgaattgttggttcaattattaacgaaaaaatgtctaagtagaaattaagattcatttgaatttgattaagaaaataaaggaaaatacaatggagttttgactccaaggtttattaggaaagatttgagtgatggaattaatttgctttgaaaaatgaacattttctaagcatcgcgtctcctaaacatacatctaaaacggtaaacatacaacgtgtgtgcgtgtcggtgcttgtgtcggtgtacatcactataaagagtccattatcctttacatttccctagtttacatgctatggtcttgtaaggaattaaaaggaaattaaactacctaaaattacatgtccatttgacatagaaattgaaagataaaatgcctaaactacaaaaaatgaagataaagtgataaagtgcttatgaaatggatgaaacatgaaatagaatgattagtagaataaggcataaatggtaagaaaaagtaagcaattgaatatgagataaaacggtgaaaatgacgacaatagccgaaacgtaaaaggaaacacattacttgaaacacaagaaactaaaaaatcacatctaaaacagtaaaacaaacacatgatcagaggcatattcatcacaaaattgcatatcaatcactcatatcatatatcaaaatattatgaacaaaaatgtggcaaaaattcccaagaatcaacttaaaaagagaaaaaaaatcaagaactaacacacacattttatcaatttcttaacatgcaaaaatatcacaaaaatatcaaaaatgtatcaagaaacacatagaaaatttttaggaattttatggaaaaaaataaagcaagcaggaggtccacatagcaagaaacaagggtgtgcatagcatgaaaaaaaagtaaaaacgcagaaaaaaaaccaaaagaaacaggcccaagcccaagcctaaggggtccggccgcacaggaaccacaggattgatccagaggatcaaaccctagatctaacggtcaagatcaaaggatggtgaaccaaagctggaccggtctggttcggttgcttataaaatgtggagggaccggtccagtttcatttttcacttccctctctctctcttcactaattctagtgagagaagctctcacttctctcttctccctccctcgccggtttctgagaaagccggccggagaggatgaagatctggccggaaccttcaaggtccgccggaatcttcatcttctccggcgagatctgcagattccgacgttcaaaaattccagaattcgaccaaaactactccaaattcgaccaaaactactgcaatccactcgccttctaaacctgagtatgaatccaccactgaaatttgcaggcaaggcttaaatcaacgtagatctagaaaaagctttacggtctttcgaagaaaattttaggttttttacttttttgaatgaaactgtttagaaactccaagatctacgttgatttgtctgtgttgatgtgttttgaaagaaaaggaagaaaaagaaattttgagtatgttacctatggttttaatcggagatttcgagcaagattcttcggaaacacttgattctcgttctgtttgatgatttggtgctcggaaccgaaaataaatcgatgattctttcactgatttgatttcttcttctttaccggttcaatttctccatttctttccttcttcttctccttctctaactctgtgatcggtgctggagttcctcgcctccggggaggaattcgtgccttgaattgcagaggagtcaattcagtgatgaagattcatcaatgaatctatgagaattgacgaatttggttctggaaaatttagggtttgaacttgttcttttgttcttggtgaattttctgtttttgatcctaactgacaagagagagaagattcttctctgtttgtgatgtggcatgtaatgaatgggattcttttttcttctgacactgtgcactatttataagctgccaagtgtgcctttggaccaatgaaatggtgacacctgtacttgaacttgaaatggctcggccttgtacaatttgtgacttgggacctttctgcaaaataataaacttgaaggactaatctgcaattgtaaaaacaaaaaacaaaaaaaatgcaattttaaaaaaaaatgggaccaaaatgcaattttagaaactgtctcagggaccaaaatgcaataaaaataaaattggactagaaattggtaaattggacaaaacgtaaagtgaaatctaaaataaaatcaacaaaaggactaaaatgaaccaattacaaaaatgaggtattttaaaatacctctctgtcgaaattttgatgggaaaagaccaaaatgcccctagggactaaactgactcagatgcaatttttgaaatgattttttttaacaaaaactcaacaatgatttataaaacaagttgaaaagactcagagacaatcacagggactgaaatgggttccactgcaggaaatgaccaaaatacccttcttgtatgatttttgcaaatatttgaattaaagtgcaagaaaacaaagcaatgattcagagagacttttttaatgacttgtaacacaagaaaggacactttggatggttttatgcaagaaaatcacagacaaaatcacaattgaaaatactttgagacagagacagtaaaaggtgcaaatgatacaaagtaaaggttcagagtaaaacaacagtaaattgacaattatcagtagtagaaaataaatttgaatgagtatttttaggtccaaaatcagggtataacagctgcccctatttaagtttctttgtccggagggtcaagagacggagtctttggcttgacgggacgaagacacttaaatatcaacatttgcactgtttttggacgtaaaaatacgcttgcacattttcaaatatcatgaatgccatgcaacatttggattatgaatgcaagacaaacgagagttggaactaacaaaagatgtcgtatccattgcgggactggtagacattggcaagataataggaaactagaagcaaattgacgggtacaagctgttcttggattgaactgggcacttgaccggggataaaggcaaatagacaggtacgagttgttcttggatctgaactggtcactcgaccaaaatcatagacacatagacaggtacgagctgttcttggattcgaactggtaactcgaccgataacataagcaaattgacaggtacaagctgttcttggacttgaactagccacttgaccaaacagaaacatattgacaggtacaagctgttcttggacgtgaactagccacttgaccaaacagaaacaaagttcactagggattttaacaaaatatagattgaaactgacttgacgtcgattcgatttgaaaggtagaaattgaccaatatcattggctcacaagattttgacagagaacctgacataagtattgaattgagactgatgttgacattggaaatgcaatatgcatggatgatataacagttttattaaacgcacgggcacgtaatatgcatgattatgcatgtatgaatgcttgaaatgcatgatggttggcaatttgtaagacggtttctcagacgagacattggagtattgggcacgtagtggctcgtgctatattacacattcctggaaatcctctttggagatatcgtcgttgggagacgtatcagaaccatggctgagggcaggtggctatgcaacttactggggaccaaggttcaggagatccctcgatcaccgtcatcactgctggatgtctcagtgctgggtatacattggatattgcatctatggtcaatgccttttgcatgattttataataattttgttttgcatcccatttttgcctggatcgccctttcgggttttcgacccaccggggaaataaatttttttcactgtcccattcttgcctggatttccccttagggttgtcaatccagcggggtgctcatttttgcctaagctgccccttcgggttttcaacttagcgagcttattcatttttcatgcattttcattctgttttttcattcttaccattgaccacagaccgtcctgaggaaaagcctgctcgtaacacatattgagatatacattaacatgaactcgttcatgcgtgtttcacttgaatgtaccttgttgctcaggtttgctttcaaaatagacaggaaaacttttcaattttcaagaatgtttgtttcaagcattgtcattatcaaaatagaaagaaaatgtttttttttttgcatataactttggaagtaaagaaaaaaatatagagtttcaaacaaaagcacgggctcaaattgatgtataagagtggtggtcagccaaaggcgggactccacggatttacaaagcttggaaaatggtaattttattggttggtggtacattgggcatggtaaccactatatttcctagaaatttgaattcacaagtgtagcagcttctgacaagaacaaccattgacagttacagatgtcccaaggggatggtgatttgccagatatagttacttgccttttgtttcaatctcatttttgcatgaaccgtccttccgggttttcggctcatcgagacgctcatttttgcctgagttgcgtacaatctcagcgagctttttcacatatattttctttgtcccttattttgcctggaccgccctttcgggttttcgatccaccgggaagcgcatttttggctaggccgccttttcgggttttcgacctaccacgctgttcttttcatatatctaggcaaagtatttcttgactatatcagcattcacaggatttggaagttctgcaccatccatgtgtgtaagaattaaagcaccaccagagaaggccttcttgacaacataaggaccctcatagttaggcgtccacttgccccttcggtcgggttgttggcttatcctccttttcaatacaagttcaccttccttgaattctcgaggacggactttcttgtcaaaggcagtcttcattcttacttgatatgactgtccacgagccacgacatccatacgtttttcctcaaccaagttcaactgatcataccggctttggcaccattcagcctcggataactttgcttccatgatcacacggagagatgagatctccacttccaaaggaagtactacttccataccatatacaagagagaaaggggttgccccggttgaactacgcactgtagtacggtagccatgcagagcatagggcaacatctcatgccaatctttgtaggtagttaccattttctggacaatcttcttgatgttcttattggctgcctcaactgcaccattcatctgaggcctataaggagaagaattatgatgttcgatcttgaattctttacaaagagcttgcaccacattgttgttcaggttggtaccattttcggtaatgatcttgctgggaacaccatatcgatagatgatgttgttcctgatgaacttggctaccacttgcttggttacattggtataagatgccgcttcaacccatttggtgaagtagtcaattgccactaaaatgaaacgatgaccatttgatgcttgcggttcaattcttccaatcatgtcgatgccccacatggagaacggccatggggaggagataacattgagggcatgcggaggcacatgaatcttatcagcatagatttaacatttatggcactttctggagtgttggtagcaatcatgctccatggtcatccagtagtaacctgctcgtaacaactttcttggcatagtgtgccccatagcgtggttcccgaaggtaccgtcatgtacatcatgcattaactgctccgcttcgtgtttatcaacatatcttaacaataccatgtcgtagtttctcttgtacagaatatctccatctaacaggaatctactggccaatcttctcagggtcttcttgtccctgttggaggcacccagtggatattcatggttttgcaagaactacttgatgttataataccatggtctatcgtcaaccacattcccgtcagcccgattgatcatatcttcaatagtaaacacatgagaaggtctttcaaggcgttgcacttggattattggcacattgttccaatgattcactcgaaacatggaggatagagtaggaagagcatcggccatttggttctcatcccgagggatatggtgcaattcgacctttgtaaaatatgtcagcaaacgtctcgcgtaatcacggtaaggaatcagcttggcatggtgggtctcccattcaccctttatctggttgatgacaagtgtcgaatctccatagatgtcgaggtgtttgattctcatgtcaattgcttcctcgatcccaaagatacatgcttcgtattcggccatattgtttgtacattcgaacagaatccgggcggtaaaaggaatatggtgcccctgcggggatacaacgattgccccgattcctttaccatataagcattgacaacaccatcaaagactaatccccacttgctattgggatctggaccttcaccaatcaacggttcttcgccgtcttttgatttgaaatacatgatctcttcatcggggaaatcgaacttaattggttggtaatcatcaagaggttggtaggcaagatgatcggcaagaatgctacctttgattgatttttgagccttgaacacaatgtcatattcagacaagagcatctgccagcgtgcaatcttcccagtaacacagcaggtttctcgaagatatactttatcggatccattctggatatcaaccaagttgtatgattcaccaaataatgacgcaagcgtttggcggcccaggccggagcacaacaagtcttttcaagcatcatataccgagtttcacagtcggtgaacttcttgctcagatagtagatagcatgttctttctttccagtctcatcttgttgaccaagtacgcatcccacggattcatcaaacactgacaaatacataatcaaaggcttcccttccatgggtgggacaaggataggtggttccagcaggtaattcttgatgctatcaaaagctccttggcattcatcgttccatacaataggctgattcttcctgagtagcttgaagatcggcccgcaggttgcggtcatgtgagatatgaatcgggagatgtaattcaatcgcctgaggaaacctctgacttgtttctcggtctgcggggctggcatttctcggatggcccggactttatcagggtcgacttcaatgcccttttggctgacaatgaagcctagtaactttccagatctgacgccgaacgtacatttgttagggttcaatcgaagcttgtactttctcaacctttcgaacatttttgtcaagtattcgacatgttgctcctcatcttttgacttcacaatcatatcgtccacatatacttcgacttctttgtgaatcatgtcatgaaacagagtagtcattcctctttggtaggtagcaccagcatttattaggccgaacggcatcactttgtagcagaaagtaccccatggggtgataaaagacgtcttttctctatcttcaggggacattttgatctgattgtaaccggagaagccatccatgaaggagaacaccttggactgagcagtattgtcaacaagcacatcaatatggggtaatgggaagttgtcttttggactggctttgttcaggtctctgaagtcaacacacatccggacttttccatccttctttggcacaggtacaatattggcaacccattcaggatactcgattgtcatgagaaaacccgcatcaatctgcttttaaacctcactcttaatcttgagagccatatctggatgagtccttctcaatttctgcctgacgggaggacattcaggctttgttgggatccgatgttccacaatcttaggatctagacctggcatatcttcatacgaccatgcaaaaatatccgggtattctcagaggagctggaagatcttccttttaaccccttcctctagagcagcaccgaccttgatctctcgcttgttctcttcggtacctaggttgataagctcaatctcttcctggtgaggctgaatggctttcctttcttgctcgagcagtcgagtgatctcatatggtatatcatcaccttcctcatcttcggcttcatacaccgggaattcaaaattcagaggaaatgtagggttactgtgcccaacgggtttactatggctcaatctgcgtaaaatggttggatgattttagaaagaggtttttatgcagattttttgaaatcaataagaaaatacagatgttttggttttttctggcattaccattatttccaaggaaaaggcactaaaaaaaataaataaaagccgtgaaagaaacgacgatttttattgataacgggaatgccgaaacaatcatgcccttacagaaaatatcactttcgctttgggcagagcaagaggattgctatttttttgaaaaaacaaaacttaagcaacaagacacattactcggaaacatgcatgattgaaggaatgtcgatggcatcccaatctctcgcaatggctcctggtataacaaacacaggcctaggaccaaatccagtcgcctcttcagtaattgcattgacaaacccagcactatggaaagttcttgtggagacacctgatgttggggaaaacccgagaccttctttatgcttattctcgcggagttgtattaacttgccccagccggcagcctatccttcttggacagccttctgagcgtcttttaaagaagccatagtagccccagccttcttaggctccgtaccttcaatagtcaaaccttgaaaggaagttccttcagcagatccagcttcaatgcaagagaaagatgacagctggctaaccaaatatgcctcttctccatggactgtaacaagcttcccattctttacaaacttcaatttctggtgcagggtagaggttactgcgccagcatcatgtattcatggtcttcccaggagacagctataagaagcattgatgtccatgacctggaatgtgatcagaaaattttcaggaccgatagtcattggcagatctatctccccaagaacattcttacgggatccgtcaaaggcttttaccagaaaagtacttcttctcagaggagtctctcgatagcttaactgatccagagtcgatttagacatcacattcagggatgagccagtgtccaccaacacgtttgatagcatgtcagacttgcaattcacagagatatgtaaagccagattgtgatattttcctgcttcaggcagctcatcctcactgaaccacaggttattacaagcagtaatgttccctactatgtcgccgaatcgatccacggtgacctcatgatcaacata

SEQ ID NO: 25 - protein, 236 aa, Medicago truncatula
MSVFASLAICKVAKDAAGVAGNIFAFGLFVSPIPTFRRIIRNGSTEMFSGLPYIYSLMNCLICMWYGTPLISHDNILVTTVNSIGAVFQFVYIILFMMSAEKEKKVKMLAWLMGVLGIFAIILIGSLQIDDIVMRRLFVGILSCASLISMFASPLFIIKLVIQTKSVEFMPFYLSLSTFLMSTSFLVYGLLSDDIFIYVPNGIGTILGMTQLILYFYYESKSRRMDAEEPLIVSYA

SEQ ID NO: 26 - DNA, 711 bp, Medicago truncatula
atgtctgtgtttgcttcacttgccatttgtaaagttgcaaaagatgcagctggagttgctggtaatatctttgcttttgggctatttgtatctccaatacctacatttaggagaattatcagaaatggatctacagaaatgttctcagggttgccatatatttattccctgatgaactgtttgatttgcatgtggtatggcactcctttgatatcacatgataatattttggttaccactgttaattcaattggagcagtgtttcagtttgtgtacataatcctcttcatgatgtctgctgagaaagaaaagaaggtgaaaatgcttgcatggctgatgggagttcttggcatatttgcaatcatattgattggaagtttgcaaatagatgacattgtaatgcgtcggctctttgttgggattttgagttgtgcatctctcatttctatgtttgcttctccattgtttataattaaattggtcattcagacaaagagtgttgaattcatgcctttttatctctcactttccacctttctaatgagcacctctttcttagtttacggtttactcagcgatgatatcttcatttatgtgccaaatgggataggaaccattttgggaatgacccagttgatattatacttctattatgagagtaaatctagaagaatggatgccgaagaaccgttgatagtgtcatatgcatga

SEQ ID NO: 27 - protein, 250 aa, Medicago truncatula
MSETLRLAVAVLGNAASVSLYAAPMVTFKRVIRKKSTEEFSCIPYIIGLLNCLLFTWYGLPIVSYKWENFPLVTVNGVGIALELSYVLIYFWYSSPKGKVKVAMIMTPVLLVFCIVAAVSAFSFHDTAHRKLLVGSIGLGVSVALYGSPLVAMKKVIETKSVEFMPLPLSLCAFSASACWLVYGILVRDVFVAGPSVVGTPLSILQLVVYFKYRKARVVEEQKIGDLEKGSIELEKVVKVEKIVTNCEQC

SEQ ID NO: 28 - DNA, 753 bp, Medicago truncatula
atgtcagagacacttcgtttggctgttgctgttcttggcaatgctgcctcagtctcactttatgctgcgccaatggttacatttaaaagagtaataaggaagaaaagcacagaggaattttcatgcattccttacataattggattgttgaattgtcttcttttcacatggtatgggttacctattgtaagctacaaatgggaaaattttcctcttgtcacagttaatggagttggaattgctcttgagttatcttatgttctcatttatttctggtattcttcgcccaaaggaaaggtgaaggtggcgatgatcatgacacctgttctgcttgtgttctgcatagttgcagctgtttcagctttttcattccatgatacagctcacagaaagttacttgttggaagcataggtttaggtgtttctgttgcattgtatggttctcctcttgttgcaatgaagaaagttatagaaacaaagagtgttgaattcatgccactaccattatccttgtgtgctttctcagctagtgcttgttggttagtttatggaatccttgttcgtgatgtatttgttgcgggtccaagtgtggttggaacacccttaagcattctacagcttgtggtttacttcaaatacagaaaagcaagggttgtggaagagcaaaaaattggggacttggaaaagggtagcatagagttagagaaggtggtgaaagtggaaaagattgtcacaaattgtgaacaatgttga

SEQ ID NO: 29 - protein, 92896 aa, Medicago truncatula
AGCCCTTTCTGTTCATACAGAAGCGGTGCCACCCCCTTCCTTTTCTTTTTCCGATACATGCAACATGGATTGAAATCGATTCTGTAGGATTTTATTTAGGGATGTTTCTCCCTTTTTGGTACTTTTCTCTCTTCAGGACCAACATATTTTTCTGTTAAATAAGGATTGCCGTGAAAGAGTCTGTTGCAGTTGCCAAGTATCATCATTCTATCGAAAGGAAACCTAGAACAAGGCCCGATTATAGTGCACAACCCACCAAGAAGAAGAAACCCATTACAGAAAGAGATTATGATACTAGCATTAAAAGTGCCTCGAAAATTGTTTAGCCAATCTAGGTGAGAAAGAAAATCCTTTGCTTATAAGGATCCCTTGGTGAATTCCAAGCTTGAGATGATAAAGAAGGAGCATGCACCAGCAGACAACAAACGCGCGTGTGCTTTTTCCAACCTTTTTAATCCCAGCCCTTGATTTTCTATTTTGCCACATGTCACACATCCATGATGATAAATGGGGTAAATTGAGCAAACCTAAATGGAGTAAAGATGAACTCCACGTTCTTATGGGATGAGTCAACTTTGTATCAACCGGACCAACCTAGATTGGCTAGGTGTTTAAATATTGTTCTGACAATGGCAAGGAATGAGAAAGGAGAGCAAGAGTCACAAGAGATTTTTTGAAAGACAAATTAGTTTAGTTTAATATAGTAATCTGGGGAACTGGGAAATAGAATACTAGCAAAGATAATCAAGTATTTATTAAACCATTATTTAAATAAAATAACAAATATTGTGGTGACCGGATATCAAAAGCATAATTTTTAACATATGCATCGACAACTTTGTCAAAAAAAAAAAAAAAAACATATGCATCGACAATTATTCCGAATCACATTTATATTTCAAATGAGGTTGCATGTGATAAAAAACTGGCAACCAAACATGCCATTAAGTTTCCATGTTAGAAAGTTAAATAAAGCTTATATTCTGCCATCCATTTTTCATGTTATTTGTTTTTAATGAAAAAATAATAGTAAAAAACAACTGCAGTCACGAACTCACTATCCAAAGCTAAAGAGCAAGCAATATCATAAGATACTACTTATCAGAATTATTTTTCAATACCATTTCCCAGACAAACTAATTGTATCCAGACCTAACCCAAAAAAGACCCGAACAGAACATTTTGTTTGGAAGTAAGCCAACTAAAAGTTGATGGCCAATTGCATGCCGGTTCCCATTCAAAATACGCATATAAAAAACGAAAAAATGAGAAGTATCCTATTTGAGGTTCAAAACATAATCAAATGACAGCCAGTTTCACCAGATGGGAACTCTAATTCGAATCACTTCTGCAGAGGCTAGCTGACTCTTGGTAAATGTAGATCTATTGAGACACAGAAGCACGCTATTGAGTACGATCAGATCCATATGCGGGCAATGTGGATGTCGGTTGTAGCATGTCATGATTTGGGAAATGCATTCCTGGTGGCATGTTTCCAGGTGGCATTTGCATTGGCCTTTGTAGTGGCATGCTCCCAGGTGGCATTTGCATTGGCACATTTCCAGGTGGCATTTGTAGTGGCCTTTGTAGTGGAATGCTCCCAGGTGGCATGTTTCCAGGTGGCATTTGCATTGGCCCATTTCCAGGTTGCATTTGCATTGGCCCATTTCCAGGTGGCATGTTTCCAGCTGGCATGTAAATGTTATTGTGCATCTGCAATGGCATAGATTGAGCAACTGTTGGTAGAGTTGTTCCCCATCCTGCCTGAGATTGGGGTATCATAGCCGGGTCAGAAATTGGAGTATATTGAGAACCATTATACTGCTGAGCAGGAGGAACCGTCATGGGAACAGGTTGCCCTAAAATTGAGGGCTGAGTGTTCACAACTGGTATCATAGGAATGGTATAGTCTCTACTCCTATCATTATTGACCTGTAATTACAAAAATCATCGTTGAAATTAAACCGAATCTGTGAATTCATATTACATGCAGCAAGCTTACAAAATTATTAACCAGTTGATCGCTGCCATTGCTTCCCCTTCAGAATGTATAAAGGAAAATATAATACTGAACAACAAATCTAAAATTACGACAGGTTTCTTATATTAATATTATCACATTTTTTTTATTTTTTAAATACAGTCAAGAGATTCAGAAAGCTGTGATGTAGACCAATGATTATAGGGAACCTTTCAAGACTCAAAGTTAAAGGATTTTCAGTGAATGATACACTGACATCATCCCAGAAAGGAATATCAAGGTCTATAACTAGATAGTCCAGTTCTTCAGTATATTTAACTAAGAATAATCCCATTTCTCTCATCTTTGAGGTTAGGAATGCTGAGATCCTAACAAGTTATCATAATGTTTTTAAGGCATCTCCAATTCATATACTCTTTCAAGGATTCATTTAAATGACATCAATCCTCAGTCTGGGTTGATTATTTACCTTTATACTAAGATCTGTATGACGTGAGTACGAAAGGTGAAGCTTGCAAAAACCTCCATCATATATGCAGTGTCCTTCCAATGCTTCTTTGGCCACAACAGCTGTCTGAGTATCTGCAAGCCATAGCATGTAACTCTGAATTCTCAAACTTAGAATGACAGAATGACAGTACAAAATAAAACAAGGCAAGTAGTAAATCTCTATCTGCTGATAGGTTGAAATTCCCCATGTTTCGATGCCAAGTCAATGACATAAAAATGCATAGATAACACTTGAACTATCATTGTTATACCTATCAAAGATAACTATAGGCATTGCTGAGGAGATTCCTAGTGAGGAACATACCCAGAATCCTTGAGAAAACAATCATATCTTTGGAAATAATTTAGAGGAAAATTGAGAGACCAAGAAGGTGCAGCTACAAACAAGTATCTTTGTTAAATATTTCTATCCAAAATAAATCAATCTCAGTAGGATCACTTTTGATTGAAGGATTATTAGATCACAAGAGGCAGGATCTCCCCGGCAATACTGCAAACAAAGGAGTTCATCTACATGCATATGCAAATGCATACTGTAACACTTGCCAGTTTCCTCAATAAGCCATAAGTGTTCGATTTTTTTCATAGAATTGGACAACATAGAAGCACATTTGAGAACTTTCCCTAAATGCAATGTCTAAAGCTTTAGGTGATATGGATAACAGTCGGCAAGCACACCCACTTGGTTTGCATTTTGCACTAATACTACTAATGTAGAGTACAAACATAATATATCCAAATGCTGACCAGTTAAATTCTTCAAATAATCTTAGATCGAACCTGGATATTGAATCAGAGCCTGTAAACCACCATTCTTATCAAACATTGCAATCTTTTGGATAGGACCAAAAGCAGAGAAAACCTATCACAAACAAGAAAATTGTAGAATATTATTACCTAAGCTGTATTGTCAAAAGATACTGTAAAAACGGTTGTTCAGGCTTAAAAGTACCATATGTAAAACATCCAACGTTACAGCATATTGCATGTTCTCAATAGATGCAAGAAGAACGTTACTCTCAGCCTCCAGTCTTTTCCCATCCAAACCAATCATGACCTGGAAAAAAAAATTAAAAATGAGTACTTCAAAAAAGATCTTCAGTATGCAAAGTCCGCATACAAGGGAAACCCTTGGTGGAAGGCACACACATAACTGATGGTGCATGAAAAAAGCATTCAAGTTAACTTTAGCAATTTGGAGGTTTTCAATTACACAAAGCAGGTGGCAACATATCTAATATGCTATCCCTTAAAACAAAACAGCCAAAACGTTACCTGTCCACCTCCCTCAATGGCTGATTGAGCAACAGGAAGGTAAGGATTAGTATAGTCTCTGGAGCATGAAAAATAACCAATTAGATTATTTTTTTAATCAGAATAGAAAGTAAAAGGGATCATAGCTGATCAAGGGTAACATCAAATTAAAAAAGTCAGCAATGCTTTGTTTCCTGTAAGCCAGCAATACCAGGGAAAACAGAAATACCTGCTCCTGTGGCTTTGAAACTTCACAGTTAAATCTGAATGTCCAGAGTATGTGATCTTGAGGGTGCATGGTCCCACATGTTCAGAGAGCAGATATCTGATAATGAGCGAGATTAAAGATCAACAATCCAAAATACCAAAATTGAGAAATATTAAGAGCTAATTAATGTTTCAATAAACATCAAGTTTCAGCTCGAACTTGGGACTTCAATTTATTCAAGCGCTGCCCAGTTGGCACTCGCTAATCATATTGACTGATTGTCATTGTAAGGAGCACGGGAAGAGCTATGGGAAATGGATTGAAAGTTTAAAAATGAATGAACAATTTAGTTGACTGATAGTAGAAAAAAGATCTGCTTTTCCAAATTATACCAGAATGATCCTTCTATCCTCATATCCCCCCTATTTATTTATCAAAGAAATATCCTCTAACTGATTGTTCTAACTCCCCTAACTAATTGATCAATTTGATTCAACTTCCCCAACCACTTGTCATCCTTTTGTCACAATATCTAGCCTTCAATTTCATTGAGTGAATGATAATAGGAGTAAGAAATCTATGAATGATTCCCCTACTTATCTAACAGATATCCCCTCTAACAACCTAAATTCCCTAACTAACTTCTACAACAACTGTCCCTTCCTTATATCATAATAATTAATGACTATAAACCACATTCTGTGATTCATATAATTGCAACCAACTGCAAAAAGAAGTATATAAACTCCGTAAAAAGACACTGCTTCATCTCTAAATATAAGACCCTATTGACAAAATTACGGGAATTAAGAAAGTTGGTAGCAAGTTTACCCTTCATAGTAATTATTGCTTACAAAAAAGATGTGAAATAAATTAGAGGTGTTTTTATTAAATTATAATTAATGCAGTTGGAAAATTAGAAGGGAGTCCTGTAAAAATGAGCAAGGAAATTTCTCAAGAGTATCCTATCTTTAGGCATGGATGTAGTATATACAAAAAGAACTACCAGAGCCAATGCAGAAGAATCAAACAGTTGGCTATTCAATCATCTGAGAACAAAAGCACCACGACATCTAACCACCGTATGATATCCATTAGTTGAACTATAAACATTGGCAAAAGTATTTCAATTGTTACCTAGGTATGCTTCTTCCATCCAAAGCATCCTTTGCAGAAGTGGCAGTCTCAGCATCTGAGAACTGAACCAGTGCCTAAACAGTGGTGCATAGAATTAGCTTGTGGTTGCTGCATCAAAAAAGGGACAACAAAAAAATATTTCATTTCATTAACCTGGAATCCTGCAGTCTTCTCAAAAGTAGTAATCTTATGCACAAATCCAAAAGCTGAAAAGACCTGCATAAGCAAATGTTAAACTTTCAAGAGGACGTTTAGTAAGATAAATTTTAAAATTTGAACACAAAATGAACAAAGGATTTTGCTTTCTAAGCTATGTTATAGAAAAATAGAAATACTAAAAATCAAAATTTCAGCATAAGTAATAATTTATATAAACAACCAAGCTCCATTTTATGAACACAGAAGATAGGGATTAAAAAAGAAAACCATGATAGGACTTAAATAAGACTGCAGGTTTAAGGCTTTAAGCAAATCAATACATATCTTGAAATGCTTATGTTGCATGCATTGGTGGTATCACAAGAAATAGAACATTGTAAGCAACGAGCAAAACCGATGAAAAACTAAGAAACCATAAAAATAATTGCCAAAAATTTCTCATTAAATCTCAAACATTAACTGCAGAAAGTGGAGGAATTAGTTAAGCCAAGTGACATATTTCAAATCACAAATTTCTTAGATGAATAGCTGCCAGTGGCTGCAAGGAATCTATAACTGAAATAATAATGTAAGAGTTGAAAGGAAAGGGTATTATTAACTTTAATACATGAATAGTTGATTCAAACAAAGGATTTACGAAGTTAATTGCCTCCTGAACTGTATATTTTGTGAAAACTAAGCATTTAATTGCCAAGTATAGAATGGAACTTTTAGCCTACATTAAAAGACTAAGAAAATCTAAAAAAACATCCAAACAATAGTAGGGACGCAAATGATGGTAGCTAATCTATGCACAAGTAAAATGCATATGATGAGTCAATGCAGCATGGGTGCACAAATCAGTGAAAAAATGAGGCAACATCCTAAACTACAAGAGTGGTAGGAGTTCAAGAGGGAGACTAGGGAAGAAAGAGGTAGTGATAAGGAAAGGAGAAAAGAGACAAACACACAAGCGCTATTTCTCCCAAAGCACTAAGCTTCCATCGAAGATATTGCCTTCACATGGGCCTGCTGATTCATTTATATACATGTCAACAAGTTTTCCATATCCTGGCAAAGAAAAACCTAAGCACAGAACTAAATGACCAGCATCCTCGTTATGACCGTGTTAGCATGTACAACTGATGCACACATGCCTTTGCTATTTTCTTACCAAGTGCAAGACATCAATGCTGACAAGGCGTGCGTCTTCACCCTCAACCGTTACCAACAATACATTTCCAGCAACATCTGCAGCAGTTTTGTTATGCACTATTTCTTGCCGATTTGAATATTGCAGATATACAGTTTTCCCTCGCACTTGTGCAGGCTCCGATGATGAGGCATAGTATGAAATCATTGCAATGGCTTGATTCAAATCCGCCTGTAAATTATTGGTAACAATCAGTAATTTTATTTCATATGAAGGACAAAACAATACCAAGAAAAAAATATAAGAAAAAAAAAATCACTCACAAATTCAATAAAAGCTTGATTCCGATTCGACCCGACATTGCACTTTGTGTTCACAACTTTGCCAAATGGATTCCCAAGTTCAATCAGCTCCTCCTCAGTGCATTCCCATGGCAAGTTTCTCAAATGAAGCACCTTGGATGGGGGCTGGGTGTACCGAAACTGTTGCTGACTAGAGACCGATGCCATTTCAAACAATAACTCTACCTGCTGAATTGCAACCCCTTAGACTTACAATATCCAATTTCACAATCAGGCATCACACTATAAAGCACAGACTCAGACACGACACGGACACGTCGACACCAATAATAATTTGAAAAAATGACATAATTCAATGTAATTGTATGTGTCGTGTCGGTGTCGGATACGATAGGTAGCTGAACCGGAACTCGCGTAATCCGAAGAGTATATGTGTTTCATAGTTATCACATCATACATACACAAATAATTTCCAACAGGTTATATTAACCACTTCACACATTCATGATTTAACTAGCATGCTTCAAAAATGAACCTTAATTTACAGATAAAATTATGCAATAACACCTAATAAAAAGAAAATCTAAACAAATCAGTGCAGTACAGTAGCTAAAGAGAAAAAATAACATTGTGTTTAGGGGGTAACATTTCCATGAAATTAAAATTCCAGAAAAGAAAAAAAACACATAAATTAACCTAAACCGAATCAGTTTCAGACAATAATGGGCCTTTAGTTATCGAAATCTACAAGAATAAAATCAGAATGTGGAAACGAATAAGGGAAAAAAAAATTCAATCACCAGAGAGAATTGAGAAGATAAAAGCTCAGATTTTTTACAGGTTCGAGAAATTAGGGTTGAAACATCAAAAGGGGGAAACGGGAACGAACCTTCTCCGTTAACAAGCGTTCCGTTTTATTGTTCCCGGGACCCCGTCTGGAAAGACAAACTAGTACTTATGACGTGCCTCCACCTTAAACCTTAATCATACATCATAAATTCATGATTTTATTTTTTGCTAAATTATTTTGCTTATGTGTTTTATATATTTTTTTTATTGTTGTTAATTTAGTTCTAATCTCACCATTCATTCATGTCATATATTTTCATACATGAGTTTTAACATGCATGTGAGTTGTATTTTGATGTGATCGTTTGCGTTGTTTGGATATAAGGCTCGAGGTTTTCTGTGTATTTTAAATGTAAATGTTAGAGTTCGTCTTATAATCGAAAATTCATGATGGTGAATCATCGCTTACAAGTCGTGCAATTGTGTGTCTCATGGTTGAACTAATCAAAGGAATTCTCATAATTGCTATATGATTTCAGGAGCTGGGTAGGACATCTCTCTATAATAGTGAGAGCTAAGCCACTATAAATTCGTCTCACATCATTCATCCATCCATTTATGTTGTATATTTGCATACATGAGTTTTAACATGCTTTATGGAAGTTGTATTTGGATGTATCTTCTATGTTGCTCGAATATTGGAGTCGACGTTTTCTATGTATTTAAATTGTAAATGTTAGGGTTTTTTTTTTTTGAAGGAATGTTAGGGTTTGTTTTATAATCGGAAATTCATGATAGTGAATCATCGCTTCCAATTTATGCAATTGTGTGTCTTATGGTTGAACTAACCAGAGGAGTTTTCATAATTGTAATACGATTTTCAGAAACAGGGTAGGACATCTCTCTCTTATAACGAGAGCTAAGCCATTACAGTACTAATCACTCACCATTCATCCTTCCATTTACGTCATAGATTTGCATACATTGTGTAAGTTGGATCCTGACTTAATCTTTTACATTATTCGAACATGCGAGTCGAGGATTCTGCATACTTTAAATGCAAATGGTACTTTTTATCAAAAATATCTTCATCGCTTTCAATTAGTGAAATTGCATGTCTTATGGTTATAATAATCAGAGAATTGTCATAATTGTTATGTGATTTTCAACATCAAGTAACATGGTGGTGCATCTCTTTTTTGTAGTGTGGGGCGAGTCATTCTGCACAGAACCACCACTTAGGCAAACTTTGGAAATAGGTGATCGGATTGTCGTGTTGCATATATAAGGTGCGCGTGACAAATATGGTTGTATGTGTTATTTTTGTTTTACGTGTGACAAAGATTTTCTTTTTATAGGTTGCGTGTGACAAAGATATTTTTTACAATTTGTTGGCGGGTGCATAACATATATTGAAGGTAAGAAGGATATGAAAGAACAACCACACAAAGACTAAACAAGGGGTATCAGTCCCCAAAACATTAGATGCCAACAAATGGCTAAACTGCGACAGACACACATCAAAAAATAAAAAATCGGAATCCAATGAACCTAAAATTTTTGCTAATGCACCAAGACGTTCCAGTTCAATTTCAACAACCGTCGAATCTTCCACTTTAAGAGCCATATCCTCACAAATTAAGGATTTACACCGCCGCCACTAAATCCACATGCAACTCAATGGGCTTAAAACCAAATAATATATCATACCTAAAACCTTGAACACCGTCACAACTCCTCCACATAAGCACAACAACGCCTTACATTCCTAGTAAAAACACCTGGCCACTCACCATCGCTTCCTCTTACAACTCCTCCACAACCAACAAACACACCCTCTTTACAAGAACCATCAATATTCAACTTCACCCAACCACGCGCATGGGGTTTCCATCATATAAGAATGGTCTCACGCACAACTTTCATCATTTTTACGACTACTACGCATGGTGATCCAACCCATTAGTTTGTCTTGGTTATCTTTGTAATATTTCATTTTTCTCCTTTTTGGCTAGTTATCTAGCGTTATTTGTGTTGTAAACACTTTTGTTCTCTTTGAATCCTTGTGCGTCAAAGAGACATTTTATCTATTATATCTTTTGGCTTCTTTAAAAAAACTAATTTTTAATTTTTTAATATTCATAAAAGTAAATATTGATTATTTTTTATGATAAAAAATAAAAAATAAAGTATGATTGTCATAAATAATGAAATGATATTTTCTAAAATATAATAGTCGATGAATAACTCTTTATTTCATAAAAATTATCGTTAATTCATTGACTCGAAAAACAAGTGCATCATTATATATTTATATAAATTTATGCAAAGCAAATGTAGCTCAATTTGCAAATGTACCGTAAAAGCTCCATAATTAAAATTATATATTTATATAAATTTATGCTGCGTATAAACATAAAACGAGTTGGGTAATCTAAGTCAGTATGCCTCTACTCATTTTATTGAGGGAAGTATTTATCTATTTGTTGTTTTGAAATTTGAATCTCAATTACTACGGATCTATAGCCAGCTCGCACAATGTTTATATATATTAGACAAAGAGAAATGAGAGAAATGATTGATAAAATAACAACAAAGACCGTAAATCATGATCCAGTCTGACCAAGAAGGACATCCTTATAAGGAGTGGGAAGGGGTATATCAACTTTGGTCTCTTCACTAATTTGACGGTTAATCATTGGTTGATGATGACCCAAAATCAAGGGAACCCGTCCTTCTCTTGCACTTACTAGTCTCTCTTGTGCTCCACCTCGCAATTTCTCCAACCTCATCGTTCCATTCATTTGTTGCATTTTGAACACTTTTATCAAATTTGTCAATCCACCAATGAAGAACATCAAGCTTCCAAATATGCCAAGCCAAACCCAAGTCCCACCCTGAATCATAATCACAACAATCCAAGCATAAGATTAAGAAACATATGCATGTTTCTCAAAAAAGAAAAGGGTTAAATTTTGGGCATGTTTGGATTGAATCTTTGGATTGATTATTTGAACTTATATAATGTCATTGCCACATTGGCATAAACACTTTGTGACATCATCTTGATAACTTATGAAAACAACTTATGATGTGTTAACAATTTTTTTTCATAAACTCTTCATAGTAGCTTATGAAAACAAGCAGTTTTATTTTATTTTATCTTTTATTATAGAAATAGCTTTTTTATACATAAGCTGTAAAATGTGTTGTGTTCTCAAAATAGGACCTATTCGTTGGCAATATGTCTACCAACATGTCTACGCCGATTCAAATCTATCTCATACCCAAAAATTTGTTGATACACCATGAACTATATAATTTATTTGGTGTTCTTGAAAATCACTAATGGACTCTAAATATAAAATCTCTAGTGCTTTTTCTTTCTTCATATTACATGTATTTTCCCAACAAATTTGGATTTTTCAAACACACCTGGACTTTACTAATTAACTTTAAACAACTCAAGCTCAAACAATTTTTTTTTTCTTCGGTAAATCAAACAACTTTAAATATTCGGCTCAACTCATTTTTTAAACGTTCAATGTTACTAATTAGTTATTAGACTTTATCTTACATCGAGTTTCAACTTGAGTTCTCAAATTCTCTTATCTCTTAACTCAAGTCACTTGAGTTATCCAACCCCCTCAACTCGGCTCGTTTCACCTAATTATCACTAATCTCGCAATAATTACCACAACCATTAATTAAAATAGCTAGTTGGTGTAATAATTGAAGTATGTAGAGTACTTACAAGCAAGTTCATTCCATGGTGGATGATTCCAGATTGTTGATGATGATTAAGAATTGCACCAAGCATGAATGACAAACTCCCCATCAAAAAAGGGATATACACAAACTGCTGCAAGATTTGAACATGTCCATCCGCTCTCTCATAAATTTGACACGAGTTATGAATCGATCCTACCATCCACAATACAGGACCAGCAACTAGCATGTTCACAACATGCTTTTCCAATTTCAAATAATATCCTTTCTCTTCCTGTCCCACACATCAACATAAAAATAAGCAAAAGACATTTTCCAATTTAGATTGAATCCTATACTTGGTTCTTACTAATCTTTCAGTGTCCTAATAACTCATATCACTAGATTACACATTTGAAAACTAAACATAAGTTCGTTATAAAATCAAGATATGACACAGTAGGTTAAGGTTCAAACCCGACTACTAACATTTTATCCTCATGTAAAAAAACTAATCAATATTTTCTATCAAATAAAAAAAATATAAGCATGTGTTTGGACAGACTGTATAATGTAACATGTAATATAACTTTTGTCAAAATCAGCCCCGTATGTCAAAATATAAGCATGACTCTTTACGAACCTCGATGAAAGTGAATAGAATTCCTAGAAAGATGAGAAGCGATCCAAGGATCTGAACAACAGGAGCAGCAAACTCAACAAACAAGAGTTGAAGATCAAAGGGCAACAAAGACGAGCGGAAATCAATGGCAGCAAAATGAGCAAGAATATCATGAAGATTAACAAAGATAATAATGGTAAGAGCAATAAGAAGAACAACGAGGCCCGAACGGGCTTCAGGAGAAAGCTGGGCCACAAAACCGGAACAAAGGATCACGGTGGCAAATAGATATAGGCCTGCGTTTATGTATTCGTAACGGTTTCTAGTGAGGCCCGGGCCGTATGTACGGAACTCTCTTGCTGAAGCTAGTTTCACCATTGTCTGAAAAGGAATGTGTGTGTAGTGTTGGGTTGGTTGGTTGTGGCAGAGAGAGAGAGAGAGACGTTGAAGAGAGGAAAGAGTTGAGATTTTGGCTTGGACACGTGGCTACTTGCATGGAGTTGTGTTGGTGTACTGTGACATGTGGCATGAGCAGAGAGTAAAAATGCCGGTTTTTGCGGGAAAATAGGGTAGCCAGCCATGTCAACAGATCTGGTTATGGTTATGGTTATGGTTAGTGGGCCTATGTTGGGCTTACGTTTCCTTAAGACCCAAGCAAGAGGAGTAAATGAAACAAACAAAAAAGATACCAACTAATTCACTGTTCTAGACTTGTAGATTTTTCTCGCGCATTAATATTATGATTCAAATTGATTGTACTATACATAGTATCTTGTCTTGCAAATTTTTTGGGCGATATTTGTGGTTTGGGATAATAGTTTAATAACTTATTTAACACTATGTTTGGTGATCATATCATTCTTTTGAACTACTTTTTCTCTATATCTAACCAAATTTCATAAAACTAAAGATTTCTCCTTAACCTATTTTATTTGTTTGTTTTGGTGCATTTATCTACTTTTTTTGAAGGAATTGGTCAAATTATTGTTATGTTGCAAGTAGTGGTGTGGATTGATCCAGCTTTCCTTCTATTGATTGTTATTTTTTTTTTGTCATGCATTAGGATTGTTACTTATCTACTTTAATAGATTTGGGCTTGTTCCATTTTTACATCCTATTTATTAAAATTGCACATTTGATTTTTTATTTTATTTTTATATACTATTCTAATCAATTTTAGTCATTTTTAATTGATAAATTAGATTGACATATTTTCTTATTGAATTTTAAGACAAAGACAACTCAGCATGTGTTTGTTTTGGCATTGAAAATTCACGTTTAGCATCTTTTTAATAATTGAGTTTTTGATCATTGTTTTTTTTGTCAACATCAACCTAAGAAAATTCAACATTATATTCCTCCCAAATACCCATCACTTTTGCAAAGGGAGAAAGGACAACTAAAATACAAATTAAAGTATCAACTTGCTCAGTTGCTTGATACTCACACAGCTGGGTCCTGGATAACTTCGTTGGTCCTTGATTAACTACGTACTCCTGGTTTTGGTTTATAATTATAATCTGTGTGTGCAGCTAAATTGTTTATCTTCTCTGATTTAATTTTCCCATTAACGCTTTTTATTTTTTACTTTTGTGCTATACGTGCATGTCATTTTCATCTTTGTTTTCACATTTTTTTAAGAGCTTGGTTTTCCCATTTGCGAAAGGGAACTTTGTAAGAAACAGCTGTAAAAACTACTATCATCGTAAAATATATTAAAGCTGTAAAAAATATTGAACTTTTCGTGTTAATTGGATTTTTTGCTCCATAATTCAAAACCCTTAAACTAATAAGCTCACTGTTTACGCATGGTTCATGACTTCTGATCACTATTTTTCTGAGACAATGACTTCATGTCACTACTACTAGTAACAGGAGTGTGCATTTTAGTCCACTATTTATGTATAATTCTTCTTGATTCATGTTAACCCCCCGGCACATATATAATTTTGGACTTACAGGGAATTCACTAAGTATTTTAATTCCTAGATCCTCAAACATAAAGTTAAAAAAAGATGAATGATATTGATTGCTTAACTTTCTACTAATATCTAGGGACAATAATTAAAAACCCTATATACCTCCTGACCATAGAACATTAAAATGTTTGTCTTTTAAAAATTCTCAAGTGTATTAACTGTTTTAATAGAATATTATCAATTATTTAACATCCTTTTTTTTTTTGTACAAATTATTTTACATCATTTATCAAACCCAATAAGTAAAGAATAAAATTTATAAATGGTAAATTTGAAAAATATACTAATTATCAACTCTGAACATAAATTAACTATAAGCTTGTTACTCTATGTTGCATCTCTTTAAGCAAAAATTCGATGCCCAACGTCGTACACTATTCAAAGGAACACTTACAATGAGACAAATATAGCAAATAATATCAATAAAACATTCTTCCATTAAAAAAAAAAATCAATAAAACATTTTTTTTAACACCATACCAATCCAATTATCCACTCCACCATTGCCGAAAGTTCTGGTGTTAACTTAAGAATATTCAATACAAAAGAGTCAAAAAGGAAGAGAATATCACTCTAAACAAGCCAACATTATTGAGTCCGCCAATAGTCCACGTACTTTCTTTTTTGAGGAAAAGTTCACTGATGTACTTATTATTACACCAACTTGATCCATATAAATTTTGGGGCTGACATACACATTTTCAAGAAGTAACATGTAGGGCATAATAAGTCCATTCTGTTATCCAGATCGAATATTCATCCAAGAATCAAACTAGTTTAAGAGGTTGAAATCCCTTACCACTATGACCAAGTCATAATTGGTGGAAAAAAAATGATTCACACTACATTAAAATTGAAATGGTTGTTCATTTTTGTACATTTTTTAAATCGATCTCACATTATAGATTATAGAGAGTACTGACTTTGCTTCTTTTTATTTATAGCAATCAAAGTAATGCATTTTATTAATAATCAAATGAGAAATACAATACGCAATAACACTTAGATAAGATGATAAGAGATCTCTTTCAACTAAACCGGAGGTTCTGGGGTTCGAATAGAGTCACGAGAATACATCACTGTTAAATTTCTTGATGGAGAGCTTTGTCATTTACGAAGATCCTATTCGACTCGAAAGATTAATCTCTGCAGTTGCACGCAGATGATACTCAGTACACACAAATAACATCACATGATAAACTTGAGGAAATATTATTTAAATCAAAGAGTACAACCCTAAACATAAACTCAGATGTCACTCACATGAATGATTGTTGAGATATTAAAAACGTAAAATAAATCTACATCTATTATGACCGTGACATGTCATTCACTCCATATATCTTTTTAGTTTGATCTCCTCTTTAGTGAATGGCATCTTATCATCTACCTTGCACAAAGGATTGTACAAGAAGATAAAGAGGAACATACGAAGTGGGTCATACTTCAAGTGGCATTTTAAAATGAAGCATTTTAAGTGAGTCATAATCATCAATCACAACTAACCCAATATATATTGATGCCGAGACAAATTCTAAAATGAGGCATTTTAAAAATTAAGTAAAATTATTATACTTCTATTTAAATTATATTTTATTTTGACCTTCTTAAGACCCCAGAAACGTTTATAAAACTATTGTAGTTGTTTCATCTAGTACTATTTTTTTGAATAATAGTATTTCCTTTTTTTTTTTTTTTTTTTTTTTAGTAAAAAGCAATATATATATAGAAGGATTCTCGATTCATTTAACAATATAAAGTCTGATAAATAAACAAGATGCAAAAAACAATTGTTAAGTTTCTTCAAACATAACCATGCACCTTACAATATTCTAATGCTGAAACCTAAACAGTTCTTCCTGATGAATCCATGCGAATTCCAAACATTTGAGTGTCCCATGGCCTGTAGCTTCTTGGATTAATCGCAAGTGACAGTAAATTCATTCAATATTTGTTGAGATAAAGTTGATCTTAAATAAGATTTGGAGATTGCTAGCAATAAGCTCTTTAAGAACATCTTTAATGGTGCTCTTATTAAAAAAATATATGTCATTTTTGTTCCTATGCATATATTAAAGTCTCAAAACTAGAGAGGGAATGCGGCTAAAGGAGAATCAACTTCAAAAACCAATTTGTTCTCTTCTCATTATATATTTGTTAGGTTATCATGTGCAGCAAATTCTCTCTTTTGTTAGGATTATATGTAATTAACTATAACTCTTACGTATTACTTTTGATATGGTGATTATATATATTAAAAATCTTGTTATTCATAATCTCAATGCTTTATCATCAACTTAATGATTTTCTGAATTGATAACTTATGAAAATGATCTTTTGATTTAACTAGTCCTTAATTCTAAAGACTTTTTAAATTCGAATCTAGGATGATTTATCTATGAATGTTAGAAATTTACCTCATTCAATTTCAAGTATAAGCAATTTTTTCCACTTTTTAAGGTCATTGAATAAATGATGATTAAAAATTTCTCTTTAAAAGATTGATAATTAAAAAGTCACTAGCTTGAGTATCTCACCCGAGAAAAAAAGTGAATACTTAATGTTCACACACAAAAGTGAATATTTATTAGGGTCTTCAAGCATCCCAATTTTAGTATCTACTCCAATTTTCAAAAGTGCTGTTACAATATGAGTATTCTTTTAAAAAGTTAATTATTACAATTTTCAATGCATTTGATATAGTACAATTTTTCATTAAAAACTTATCATTTAAAGTGTTTAAAGAGTGCCCGGAACACTCGTTAATATTTCCCTATTTATAAAAGTAGAAATTAATGTAAAATAAAATAGTAAGAGATATGCTATATTTCGCAAAGGAATTTTGTCTCAAATTGATGAATTGCTTACGTGTTATCATTGTAAAATGTTTGGTCAAATATTCAAGGGTTTAATAAGTTTTTAGTTCCTATCAATATTTACAATTTTGCTTTTAGTCTCTACAAAATAAAATCACATCTTTTAGTTCCTGTGACATTTTTTTTACGCATTTTATAGACAAAAAATGTTGATGAAAATTTTTGATAGAGACTAAAAATGCTGATGGAAAATTTTTATAGGGACTAAAAATGTTGATGGAAAACTTTATAAAGACTAAAAAGTATGATTTTATTTTGTAGGGATTAAAAACAAAATTCTTAATATTTATAGGGACCATTTACTTAATTAATCCAATATTCAACTAAAGTTTTTGAAAATCCCAGTATGGGTGGATGTAAACCTGAAAATTTTAACAACCTTCGTTGTCTCTTGCGAAACTACAATTCGCTATAGAGTTGTGTTATTTGAACATCCATATATGCGATAACTTTTGTGACAATCAAAATTTTACAAAGAAAATGAGGTAGTGACACAAAAATCAAAGCAATAGAGAGAGAAAGTAAAAAGATAGAGGATTGATATTTGAACAATCATTTCATACAACTTTTGGTGACAACTTCTTTTTCTATCTTTTCATTGGTTAAAAACAATGGAGAGAGAAAAAAGAAGAGAGAGAATAAGAGGATAATGTGAGTATGAGAGAGAAAATTGTTAAAAAATTGTCACAAAGTGGTTGTACAAATATCATATCTCAAAAATATAATATGAGTATGAGAGAGAAAGTTGTCACAAAAGTTATAAAAAATGGTTGTTCAAATATCATTTCTAATACTCCATCCGTTCTTTAATGTAGGCATTTACGGCCTTTTTCACATTTCTTAAAAAATGTTGTCAGTGTAATTAATGTGTCTGTTTTGTGTGTTAATATTACCAATTTATTCTTTGTTTATATGTGTATTAAATTTGGCTTTTCATATTTCAAGACAAGTTAGTAGTATTAATTAGGGGTATGTTTAGGAAAAAAATAATAAATGCATCTAGTAATTTGAAAGGGGATTTAATTTAGAGACAAAAATAAAGTCAAATGGGGGCTTAGATATATAGACCGAGGAAGTATTTTATTATATTTAATGCATTTGAATTTAATTCTTTAACTTTAAATTAATTAAATGTACAAAATTTAAATATTTTTTTTTACTTTTAGGTTGCTTGACATGTGTCATAATGACACAAGTTAGCATGTTTAATTAAAGAGTGAAGTTATTAATTATCGTTGCATTCAAAAAGTAAAACACTTACTTTAAGAATGAGAGAGTAATTGATATCACTAGTTCTACTTTTTAAATTGACAAGTTTAGAGAGTTTGTTACTCGATAGGAACATATGTAATTCCACGAAAAAATCTTTGCTATCTTGTAGGCATAATCAATTTAAATTTAGAATTTATTTAAAATTTATTGAATAGAACCTGGTAATTCCATAAGCTAATTTTAGAGTATCTAAACTTATTCAAAACTTCTTGGATTTGTCAACTTATTCATAATGAGAAGAATTTTATTAGATTGCTACACCCATCACAGGGAGACATTTCATTATTACAAAATATCAAAAAACACATAAAAGAAGGAATCTTGATACTTGATAGAACTCTAAAATCCTTGAACTTTTATCCCTCAATAACATCAACATTGTTCACAATTTGTGACAATCTTTTCCACTTTCACCACCTTCTCTAACTCTATGCTACCCTTCTCCAAATCCCCAATTTTCGATTCTTCCATAACCCTCTCTTTTCTGTATTTGAAGTAAATCACAAGCTGGAGTATGCTTAAGGGAGTTCCAACCAGACTAGGACCCTGTAATCATAGTACCAAAAATTAAGAAAAACAATATTAGTATTTCTATTTAACTAATTTTTCTTAGATTAATTAATGAGATTATGTATGATTAAGAAACAAACCGCAACAAATACATCACGAACAAGGATTCCATAAGCTAACCAGAATACACTAGCTGAAAAAGCACACAAAGATAATGGTAGTGGCATGAATTCCACACTCTTTGTTTGTATCACTTTCTTCTGCAAAAATCAAAATATAACTTTGTTACCATCTAATTACAAGTTTACAACATCATGCTTTTGTTGTTGACGATTGTTAATCTATGTTTGATATCACCGTGAGCGTGCCAGAATCACGGTATGATATCAAACATAGACAGACTAAAAATGTTAATGTAAAATTATGAATGGAAGGAAAAATGAGTGACTCACCATTGCAACAAGAGGAGAACCATATAATGCTACAGAAACAACTAAACCTATGCTACCAACAAGTAACTTTCTATGAGTTGTATCGTGCAAGAAAAAAGTTGAAACAGCTACGGTTATGCAGAACACAAGTAGAACAGGTGTCGTGATCATAGCTACCTTCACCTTCATATTGCAATACAACATAAATATCATTAGTCACTTTCTACCTATCTTATTTTTTAATCATGCGTGTAGATAACTAGATATAGTAAAAAATTAAACATGCAATTTAAAAAAAATTAGTTAAATAGAAGAATACCCCATCAACGTCATCATTTTAATTAAAAAAAATAATGTAATGAAAACTTCATGTTGATGATGCTTTAATTAATTACCTTTCCTTTAGGCGAAGAATACCAGAAGTATATAAGAACATAGGATAACTCAAGAGCAATTCCAACTCCATTAACGGTTACAAGAGGAAAATTTTCCCATTTGTAGCTTACAATAGGTAACCCATACCATGTGAAAAGAAGACAATTCAACAATCCAATTATGTAAGGAATGCATGAAAATTCCTCGGTGCTTTTCTTCCTTATTACTCTTTTAAATGTAACCCTGAAAATTAACCATGAAAGACTTCAATACTTCATTTTCTCCAATTAAGAGTGGTAGATGATGAATTAATTATGTTATGTAACTTACATTGGCGCCGCATAAAGTGAGACTGAAGCAGCATTGCCTGCAAGAACACCAATGAAGTAAGGTTTAAGAAACTAAGGAATGTCATTTGTATGGTTCTAATGAAATTAAGCCAAGGAAACATTAATTAATTCTAATGAAGGAGCTTAAGCTAAGGATTAAGGAATGAAATTGTTAGACTCAAATGGTTCACAACAACAACTTGAGTTCGAAAAAAAATGCTTTATCATTCTTTACTTTGGTGGCCGAATTTCAAAAATCGAAGGGTTAAGAAAAAAAATTAATAACGAACAAACGAAATAATACCAAGAACAGCAACAGCCAGACGAAGTGTATTTGACATCTTTAATTTGTTTTTTACTCTCTACTTAGAAGAAGAAATGATAATATTTTGTATTGTACCACGAAGAAGAACATTGAGGACATGCTCTATTTATAGTCGTTATGTAGGACGCGTATTTAATTAACATAGTAGTGTCCAGCTTGAAACAAGTACGAAAACAAATTAGAAACTTGGGAGGAAAATAAGTCAAAAAAAAAAAGTGGTAGAAGTGCTTTCTACGTAGTTAATAATCACGTGGACACAAATTTGGTTCAACTTGAGAAGTTTTTTTTTTTATTTTTTATCAACTTGATCAATATTACCAATCCAGAACTCCAGCTTTTTTCTTATCATTATTATTATTTTCCATAAACTTTGGTGTGTGTGGGTATGATAGCTATATAATTGACAAATTTCTTGCGTGACACTTGATATTTCATGTAATCTATCATATTTTTTGGCTGTGTGTTTATTTATTTATAATATTATAATATAATTTATCAAAATCAAGTGCCTTTTCTGTTGGTAAAGCATTATAAGATACCAATAATGCATATTAAAACATTACAAAAAGGATTTGTTATGATGACGTGGCTCCCATTTTGGAGAGATACATATGAGAATAAAAACCATTTGATTCTTTTATGTTTTTACATGTTCCATTTGTGTTCAATTTTTTTTATTTGAAGTTGTGACCACACAAGTGTTTCTTTTGATTAAGTATTGTCTGATCTAATCAATTAAAAAATTGACAAGTTTCATAATTTATGAAAAGGAAGATTTAATTTGATAGGTATGATCATACTTACAAATGTCTTAAGAACACTACATAAGAACAATAAAACTTTAAAAATTGTATTGAAAAAATAATTTTTAAACTTCTAAAACGTTGAATCAACATTTACCAAAACATTATTAGTATATTTATTTCCTTGAACAATATTTTAAGGACACTAATTATCATTTTCTGAATTTTTACACATCTACTGTGTAAAAATGTTCCACATTATGAATGCGGATCCTCTCCACATAACATTGTATGAACCTTTACACAATCGAAACTCATCCATTTGACCCGAATTCGATTCTTAAATGGAACAATTATTCGCCATACTATACCTACCTTGCGACCAAACATCGGATTGCTAATATCCTATTTCCATGGAAAAAAGGGGTTAAAAAAAAAAAACGCAACCATTTGATTAATCTAATGGTTGAGAGATTATGAGAACAACTTACTATTTCAAATTAACTTTACCTCTCTATATAACACACACACACTCTCTCTATATATATATATATATATACTTTCATATATTAATTATATGCATATTAATTAAGCTTTTGCAACAAACCATCAAAAACTGGTGTGGTGCAAATCGGTTTAACTGAACCATTTCTTTTGCTCCAACCTTTAAATTTTATATTAGAAAATATTTATTTTAAGAAAGTATAATTGAAAATCCAATGATATATACACACACACAATTTTCCTTATCATTTTTGTTAATATTTTTATCTTATGAGTTATATAATATAATTATATCTTAATTAAAATTTGATCACATTTTAAGTTTATTACTACATGTTATCTTAATTATAAGAAACTTTTTAAGTATTTTAATGTCATTTATACAAAAAAATGCATATGTAATATGTAGAAGGTGGACCACTTAACTTCTAGTCAATCTATGAGCCAATTTTCCCGTACTTGTGTGGAAATATATTTGGACAAGAAACTCATTTTAAAATTCATTGCGGGTGCTTTAGATCGTGTTCTTAATTTTGAATATGAAGGATTACATGTTGTGTGTTTTAGTTATGGGAAATATGGCCACAAAATTGGAATTTATCCGGACAACAATCTTTTTGATGTGAATAAAGAGACAGATAAGGTCCTTTTTGATTTTATGATGGTTTCTTTGTTCGGGTTTCGGAAGTGAAACAACTAGTAAACTTGAATTCTACAATGAAGATCCATTCGGTTTATATAAAAAAATTCGCAAATGAATCAGAAAGATATTTCATCAGAAGCAATTGAGTGATAAATCTCAACCAAAAATTTCATAAGCAAAAAATTGTGAAAATATGAAAGGAAAAAACATAGATAAATGCAATTAATTTTTTTAATGTTGATGAGGTAATTATAGATAGAAATTTTAGGAGTGGTGGTTCACATGTTACATAAAAAATTTCAGGTGAGGTGTCGACATTAAATCTTTAGTGGGTTTAAAGGCAATGATAGTTCATAAGTCTTTGAAGGAGTCTTAACTCTCAAACTAGGATCGAGGGTCTGCTAACCGGTGTCTCCGGGGCATTGGTTAAGCATACCATAAAAGGAAATTATTACCATAAAAGGAAACTGTTTTTGACTTTATTATCAATTAATTACAATTTCAATGCATTAATTACTATATAATTTCCTTTTTCATATCCTTAACCACTGCCCCGGAGGCACCGGTTAGCATTTCCCTAAATTAAAAGGTACAAATTGTCATATTGGGTCTAAGCATGAAGAAAAGAATGATCAAATTGTCACTAGCTAGGTTAGAATGGTCTTCGTAGCATTGCCCTTTCGATACTTAGAGTGTTCATCTTTCCACCATCCCTTAGATATTTAAGAGTAGTCATAATATACCATTATCCCTTCGGAAAACTGTGCTTTGAAATATTTTGTCCCTTCGAAATTTTTAGTGATCCTATCGTAATATTAGAGTGTTCACATTATCATACTGGAGCATCCATTGTACTATATTAGAATGATCATCGCATCATATTGAAGCAGTCATAGTACTATAATAGACGGGTCATAATACTATAGTTAAAGTGTAATTTTGGAACGATTTCTATAGTGCTTCAGAAGTTCGATGTAATTTAATTCTGAACAATTTTATCATGCAGATGTTGTAGGTGATAGATACACAACTTGCACAATTTTAAGTAGTGTCATGAAACTTTTTAGAAAGTGTAACCTAATGCTTGATAATCCATTGGTGGAATGATTTTTAAATATTTTAAGTAAAACATTTTAACTTGTTTTTTTTTTTGAACAAACTAAAATGAGATAAAATAACAAAAAGTTTTGATCCCTAGCATAAGGAGTGCCAAAGGAAACAAACATTTCAACTTGTTATTTAAATTCATAACCGAATATGATTTTTAAATAGTTTTCGAAGCACAAAATTTATATAAATTATACATAGAAGTAAATAAATAAATAAAAAGTAAGAAAATTTGAGTTCCCCAATCCCATTTACATGCTACTCACAGCACCAACAAAATAATAATAATTAAAGAACATTATAAAAAGTTACTTTTTCTCAAAACTCACCTAAATTCATCACAAAATAGATAGGAAATAAACTCTTATACTTAAATTAAAATAATTACTCTTTCATGACTAAATAAAAATTCCAGAATTTAAATTTACTTGATTTTTTTTTCATTTTATTAATATAATAAAATATTTTCTACTAATTCTAGCACTATAAAATCAAATATTATAAAAAAATATGTTCGCATCCTCGACACTATAAAATCCTCAAAAAAAAAAAAAAAAAAAGGAAGTTGAAAATAATTTTTATAGCGTCGAGGGTGTAAAAATATTTTTTTTTATGATGTTTGATTTTATTCAAGTGTTTTTTGAAAGGAACTTTTTCATTCAGGTGTTCTTACCAATTTTAGGATTAAATGTAGTTGAGGAAATGGAACGTGATTGCCATGTAATGATCAGTTTGGGGTTAAAATTGTTTCAAATTCTCCATCAATTTCTCCCTAACCAAACCAATCAGAATTATTTCTCATCAATTCCCTTAATCACATTTACAGTAATTTTTTTGACTCTCCTCTCGTAGTCTTCATTTATTGGATATTAATTTCTTTCCTTCATAAAGTTTTCACCAAGCAAGGAGCCTACCCTATACATGCATCGACGTGCTCCTTATGCTAAATAGCGAACTGGTCATGTCGCACTCCCCCTCCTAATATAATTAATCACTCAAATAAATTAATTAATTTTTTTTTGAGCAAATAAATTAATTTATTTATCACTCATTATACTACTAACATCTTAAAATAATTTTTTTTTCTACACATTGCTAAAAAAAATAACACATGACATTAACTTAATAAAAATCAAAAGGTAGTAATAATAAATATTTTCACACAACAAAATAATATATATTAGTTCAAGAATAGAATAAAATATCAACTATTGATCTAAGGTTATAAGGAGAACGACGCCCGACGAGCTTTGTAAGTGAGCAAAGGGGTTACATAGAAAAGACACTTTGGCCTTCAAGTTTGTAAGTGAGCAAAAAAAATAGTTTTAGGATAGTTTGATCTTGTCTTAGGGAACTTTAGAAATCCTCTTTTACCTTTTTTATATGCTAGGATGTGGAGATCCTTGGAGTGATGGCGAGGTAGTCGTTGGGTGATGGTTATAGGTGGTGCGGTCTTAAATGTGAGATGGACCGTTAATCTATCCTTAAGGTCACAAATGTCCTCTAGAAGGGCTCAGGTGCCCTCCAGATGGGTTCTGAAGCCCTAGGCGCGTCCCCCTAAAGGTGCCTCCTCATCAAGCTTCTAGAAGCACCTAGAATGTTGTAAAGTGACTTAGGGCTCAAGTTACTTGGGGCTTAAGTCACAGAAATACAAGCCCGTGAAAGACTATAAATACCCCTCTTGAGATCATTCTCATGACATGACCTAAACAGACTAAACCATAGTTTTAGACATTGTAATCATTGCAAGTACATGAGAAAAAGGCGTTATGAATAACTTGAATCCAAAGAAACTTAACGTCTGCAGTAGTAAAACGGAGTTTGTGTTATGTTTTGGACTTTGGATACTTGGGCCTTAGTTCGGCATGGATGTATTGGGCCAACTGTGTGTTCAGGCCAATGTTCGACATGGATGTATTGTGCATTCCAAATTTTAAAATTCGGATTCATGTTTACTATTTCAGATTTTATAATCCGGACAATTCTTATGTATAATCATCCATCAGACTCTCTCACAATTCAACAGTTTTGAGTTTTGCTTTTAAAAACAACAAAAAAACTAAGTAAAAAAATGTTAAAAACCTGTCAAATAAAATCATAAAAATAGCACAAAAAAATTCTAAAAATCAAATAAAACTAAGGGTTAATGGTGCTTTACCCCCTGTAATATATGTCATTTTTTATTTTCCCCCCTGTAAAATATTTTTTTGATTTATTCCTCTGTAAATATTTTTTTTTTGGAATACCCCCCTAATAGGTCATAAAAAAACGAAAAAATTCTGCAAAAAAAAAAATAAAGTCGTTTTTTTATGACCTATTAGGGGGTATTAAAAATATATATATATTTTACAGGGGTAAATCAAAAAAAATATTTTACAGGGGGGGAAAACCAAAAATGACCTATATTGCAGGGGGTAAAGCACCATTAAATGCAATTTTTTTTTGGATTTTTCTAAGAATATGAAAAATTTAAAAAAAAAATGAAAAATAGGTCTAAACGATGGAATTTTTGATTTTGATGGGCGGAGTCCCGTAAGAAGTTTCTTCTGCGGGAGTAATGGTCCTTGATTTTTTTTTTTTTTTTTTTTGGGAAGTTTCGAAGAGATTAATTGTCCAATCTTAATTTGATTCATAAGCAGTGCAACTGTAAAGACTCTTGCAAGCTTCCGACTCTAATGCCCGAAAGAAAAGGATACAATCATATGTAAAAAGCAAATCTGAAATACAAGATGTTCTTCTAAACCTTTGAACCACTTAGGAGATATAAAACCAATTTGGATTGCTATTAACAATGCTGGAATAATTAACCGTGTGTTAACACAAATAAAATTCCATTCCATCCATTTACAATCAAAATCCATCTTTATCGTCCTCAAATAACTCCAATCAATGATATTGTATGTCTTGCTAATATCAATACTCTAGGTAACATTCTTGGCTTATCCCTCATCCCATACTTTATTAGGGTTGTTCATGTCCAATCCAATCCAATGTAAATCGCAACCAAACCAAAAAATAAAAAATCAAACAAAAAAAACCCGCAATTTTAAATGGATTGGATTGGTTTTCGGTTCCTTTAGTATAAACCGATCCAATCCAATCCAAAACGAAATATTTATACTTGTATATATGATTATATGAATTTTTTATAAATGTTTCATTAATTTACAATTTTTTGACTATTATCTAAACTTTCTCTATAATTATGTTGACTTTTTTTTCTTTCTTTTAAAAAATATTATTAATTTACGAACTATTTTTTTTTAACATACTATTTTATTTGGTCTATGTTGCTTTTATTTTCTACTTATTCATCTTTTCGTGGCCTTACTTTTTTATTAAATGTCATAAAATAATATATTTTCTTAAAAAAATAAACAACAATGAAAACCGAAAATCAATCTAATCCAAACTGATTTTTTTTAATCGGATTGGATTTGATTTCAAAATCAAACCAATTGGATGAACAATAAGAAAACTAAAGTGATTGGATCAGATGATTTTTCCTCCTAAAACCGAACCAATCCAATCCCCGAACACCCATACTTCATGGCATTGAATATTTCAACTGCAACATGCACATTATGAATTATAGACCCCCTAAGAATATAAAAAAAAGACCAAAACTCTAAAATGCCCACATATAAAATCATTCAGTCAATTAGCTAAGAATTTAGAATCAATTTTAGAAAAGACAACAGAAAGAGAAATAGGCTTTCAATTAGAGACAGTCAAAGGCTTATTCTTTTAACGGTGCCAATTTCACTTGGTTATTTTATAGATAGTTGGCTCTACTTTTAAATGGATCACGCGGATAATATCATTAATCTTTCATGTTAGTTCGTTCTTGGATCGGATACCGAATTTAAAAAGAAAAGTTTATTGTTTTACACAAATCAAAAGATATTTTTGATTAATATACACATAACTTTTCATGTACATCCTCTAAAAAAAACAACTTCTTAAGGATAAAATAAAAGTACAGATGACCAAAAAAAGTTGATATAACCTTGACCTTTGAGATGATAATTTGGATATTTTTCCTCTAAAAAATTGATAGTTAAAAAGTAACTAATTAATTATTTTTTATGCAAAAAGTCACTTGCAATGAGACGGAATTAGATCCTCTCATGTCCTTTTTATCCCGCCATCCCTCCTTTTCCTAATCCAATGGTTGATTGATTTACAAAGTAAAAAACAATACAAAGGAGAGAGAAAAACATGTGGGGTGAATGGTTGAGATTAGTGCAACACAAACAACATAAGAGAAATGATAGGATGATCCAAATTCCAATGGGACTAATAAATATGACTTTTTAAAGTGAATACTTAATGTTAAAAAAAATGTGAATATTTAAGTTTATGTAAGATCTACCAAAAAAAAAAAGTTTATGTAATTTGTTATGCATGGAAATTCAATATCACCCATTAACAACATGTTTATAAACAATAATTGATATTATTCGTTCTACTTTCTAAAGTGATTTGATAAGTTTAGAGAGTGTTTCTTTTGAGAGGAAGTTAGAGAGTATTGTTTTAAAGTAGCATATATAATTCCATGAAAAAAATATTTGGTATCTTTTTTTTTCTTCTGTGAGGAGAACAAATATTTGGTGCCTTGTTTAGATACCGATATCTTGTATGAATAGTTAATTTAAAATTAAAATTTATTTTGAAATAATTAAATAATAAAGATAATATAACATTAAATAAGACTAGATATTAAGCAATATATTATATTCAACAAAATTTGAGGGTATTCGAGCGTAGCCTCAGCTTGAATACGCGGTTGTAATCCACGTTTTTTTCCCTCCAAAATCACGGAAAAAGCAGGCATTAATGTAGGCTTTGGCGATAATTGATTTTGGGTGTATCGATTATGGAAAGTTGATTCTGATTAAAATTAAAAGTGAGTTGAAATTGATTTGTATTTAAATACATGTAAAAGTAAATTGAATTATGAATTTGTGCTAGAATCAATTCTAGAATAAAAAACTACAAATAGTAGCTTCATTTAGAATTACTTTTAGTTCGCAAAATTAATTTCTCAAAAAAAATTGTCAAAAATAATTTTAAAGAGTTAAAATTACTTTTGGCATTTGGAAAACATTTTCTAGCTAAGAAAAGAAATCAAAAAATTAAACCAAACACTCTATTAGTTTTGATCATCAAAAGAGAGAGAAAGAAAGAGAAAGATTTGATTACAACACCCATAGTGGGGGATATTTCATTACAGTATACAGAAAAACACATAAAAGAAGGAATCTGAATATAAGTCTCTAAAACCCTTGGACTTTTGTCCCTCAACAACATCAACATTGTTCACAATTTGTGACAATCTTTTCCACTTTCACCACCTTCTCTAACTCTATGCTACCCTTTTCCAAGTCCCCAATTTTTTGCTCTTCCACAACCCTTGCTTTTCTGTATTTGAAGTAAACCACAAGCTGTAGAATGCTTAAGGGTGTTCCAACCACACTTGGACCCTGTAATAATCATAATAGCAAAATTTAATAAAAAAACAATACATACTAATTAATTAATGTGATTATAAAGAGTGATTAATTTAGAAACTAACCGCAACAAATACATCACGAACAAGGATTCCATAAACTAACCAACAAGCACTAGCTGAGAAAGCACACAAGGATAATGGTAGTGGCATGAATTCAACACTCTTTGTTTCTATAACTTTCTTCTGCAAAAATCAAATATAACACTGTTATTGTTATTATCTATAGTAATTATTACAATATGTTCCTCTTTTTTTTGGTGATGAATTTTGAATATGTGAAAGAAGAAAATGACTCACCATTGCAACAAGAGGAGAACCATACAATGCAACAGAAACACCTAAACCTATGCTTCCAACAAGTAACTTTCTGTGAGCTGTATCATGGAATGAAAAAGCTGAAACAGCTGCAACTATGCAGAACACAAGCAGAACAGGTGTCATGATCATCGCCACCTTCACCTGCAAATTATAAATGATGAAAACTTTAGACATGTTGATAGATGATGGTGCTTAACATATGTTTGGTATTATGTAGTTGTGCCAGAATCACGACGACCTATCGTGATTTGTCAAAAGTTATAGAGTGTGGTTTGGAAAATCATGATGGGTTGTCCCGATTTTAACATACCAACGTGATACCAAACATACACTTAATTTGTTTTGGTTGCAAAAGATTTTAAACTAATGAAAAGCTGGCATGTAAGTTAACTAATTACCTTTCCTTTGGGCGAAGAATACCAGAAATAAATGAGAACATAAGATAACTCAAGAGCAATTCCAACTCCATTAACTGTGACAAGAGGAAAATTTTCCCATTTGTAGCTTACAATAGGTAACCCATACCATGTGAAAAGAAGACAATTCAACAATCCAATTATGTAAGGAATGCATGAAAATTCCTCTGTGCTTTTCTTCCTTATTACTCTTTTAAATGTAACCCTGAAAATTAAGCATCAAAATTAAGGATTCAACACTTCATTTTGGTAGATAATGAGTGGTACTAATGAATTGATTATGATATGTTACTCACATTGGCGCAGCATAAAGTGAGACTGAGGCAGCATTGCCTGTAAGAACACAAAGGAAATAATAATTAATCCTAATTAAGGAGGAGCTTAAACTAGCTAAAGAACGAAGTGATTGGATTCAAGTGGTTAATATGTTAATCATTTTTCTGAGACTAGTTAAGACAAAAATGAAATTAAGAAATGAACGAACGAAGAAATACCAAGAACAGCAACAGCCAAACGAAGTGTCTCTGACATGTTAAATTTGTTGTTTAGTCTCTACTTAGAAGAAGAGATGTAATGTAATATTTTTGTTTTGAGAGAAGAGCATTAAGGACATGCTCTATTTATAGTTGTTACTTAGGACGCGTATGTAACATGGTAGTGTCCAGCTTGAAACAAAACCGTACGAGAAAGAAATAAAAAAGAGAAAAGAAATTAGAAACTTGAAGGATGAAAAAGAAGAAGAGGCAAAAGTGGTTTGTACATAAGTAATAATCACGTGGACGCAATATTTGGTTCAACTTGAGAAGCTTTCCATCAACTTGAGAATTCCAGCCTTTTTTTCTCCCTAGTTTTTAGAGGCTTATTGTTATTATTTCCCATAAATTTTGCTAGCTATTATTCACAAATTTCTTGCGTGTCACTTGATTTTTCACGTAATCTATCTTATTTATTTTTTGGCTATCAATTTACTTATTATTTGTTTATAATATATAATATATAATTTATTAAAATCAACTGATTTTGCTGTTGGTAAAGCATTATAAAGGTACCAATTATTGAACACATTATTAAGATGATTTGTTCTTGATGACGTGGCTCCCATTTTGGTGAGATGCATATGACAATGATTATTAAGTTAGGGGTGATTGTTTCATGTTTAAAAATGACATTCTTGGAAATACATGACTAGAGAATGATTATACTCATGTTTGTTATAAGGTTGAGAAAAATTATTATTGGATATAAAGCTTCTTATGAATAAAGTAACTTCCATTAATATCATGAATTTATTCCTATGTAAGAAGGTGAGAATGTGCATTCCTATGAAATCATATATATATATTTTATTTTATTTTTTAAATTGTGACTTCCAATTTTCTCAGAAATGTCAACTTATTTGCCGAACACTTTTTTTTTTTAAAAAAAAAATACCTAGTACATAATCCAATTTTCATATTTTTATTTTCAGATAAGTAATTTCTTAGTATAATTTATGTGTCGCTGAAATAAACACCCCCTTATAATTTAGTTTTTTTCTCGAAGGATGCGCCTGAAATTGGACTGTATAGTTCAATTTGAAGGGTTAATTAAGAAATTGAAGAAAAGAAAAATAATTTTATGCCACAATTTCAAATAAAAATGATTTAGACACACATAAAAAAATATATAATTAATTATTTTAAAACTATATATGCATCATTTAATTCTTTTAAGCTTTATCTTTTTCATTTATATTTGCGTGTTTAAATAATTTTTATTTGAAAGTTGTGACCATACATGTGTTTCTCTTGATTTTTAAAAAGTTGTATAAATATTTGAAAGGGTACACTTTTTTCTAATGACACTAGTTAAGTTAAAGAATTCAAAAATAAAAAATTTGTATTCAAAACAAAACTTCTAAAAAGTTGAACTAACATTTTCCTACATATTTTTACTATATTTGTTTTCTTAACCAAACCTTAAAAATATTTCATTAGTATTTTTCTATTTTTTTTTACTCATATACATTGTAAAAATATTTTGCAGATTCATTCCGTTATATCTTATCGCTATAGCACTTTCTAATATTAAGACCTATTATCTTCAAATAGATTGAATTATTCCTACACATTTCCGCTACATTTGTTTTCTTAACCAAACCTTAAAGCATATTTCTCTAGCATTTTCCTAATTTTTACACATCTACATTCATTCCGTTATATCTACATTGTAAATATATTTTACATATTCATTCCGTTATATGTTATCATCATAGCACTTTCTAATATTAACACCTATTGTCTTTGAATAGATTAAATTATTCCTACATTTGTTTTCTTAACCAAACCTTAACATTTTCCTGATTTTTACACATCTACATGTTATAGCACTTTCTTATATTAACACGAACACTTCTTTACATTTACATTGAACATTAATTACACTCTTGTGAAAGAAAAAAAAAATAATCCAAGAAGGCTTAATCGAATTTTTCTAATGTTAGAGATTGGACAAAATTTTGGTTTGAGTGTAACTATCTCTTCACGGTTTAAACTTTTACTAATGTAAATTTGATTTATTGGAAGCTTAATGTTAAAAGAAAAATTGTCTTCATAGGAAAATTCATTTTAGATTTTCTTGTGTTTACGAGAGGAGAATACTTGTGTTCACAAACTAACCAATACTTTTTTTTCGTCAATGAATTAGTCTAGTTGGATCAATTATCTATTTGTGCTAGAGAATGTTCTTTAAAGATATAGGGTTGGTTTACTTTCTTATAGGTTTCAATGATCTTATTTTGGTGGATTTGTTTTACACCTCCCAACTTTTGTTTTTCATTTTTATATTTTTTTTAATAGGCTAAATTTTTTTCATTTTTATATAAATAATACCTTTGGAGAGATTGTATAGGATTGGTGGTACATTTAGGTGCCAAGATAGTTTGGATCTCAACATGTTACAATGATACAACCTTCTCCATATTTGCTTAGTTTCTTTTTATCATTAGTTTAATATAATTATTTTAACTATTTGTGTATTCAACACATTAAAACATAAAAAAACAATATTTTTTTATATGAAAGTTATAAATTATTTCCATTTTTTGAATCCTTTCACAAGTGTCCTAAAAATACTTGTTAGCAAGACCCAAATATTAAACAACGGTTAATTTGAAGTTAAGAGAGAGTGCATTCCGTAAGATTTTAGATGATTGGTGTCTAAGTTACATGTGTAATTGCTATTTTAGTGATATTTTAATACAACACCTCTCTAAAAAATATTAATATATCCTCAACGTTAATTTAAAGAGTCCCCTCTAAAATAAATTAATTTAGAGACTCCTCCAACTAGCGACATGACAAAATTTACAGCAACATTTTTTTTTCCTAGGACTGATCCATAAATCGATCATATATAGAGCGATTCATGCAACACTGAATATAGGTTGTGTGCACTCATAAGTCACAACCCGTTGGTTTAACGGTCGTGTGTATTCACAACCCTATAATTTTGCACAGTCACACATATTTCGATCCACCAATTAAGAAACTACTTTTTATATTTAAGACTCACTAATCTATTTTAGATTTTAAAAAATTAAAACTGCTTTAAAATCTAGATCATCCAATATTGGTTAGAAGACCATGATGTGTGTAACCGTGTGTGGTGAAGGAACGTATCTCTTATCAAATGTAATGTGAAAAGGTACTTGTATTAGAATTGTATTAACAACATTTTTACATTTTTGCTTTTTCTAGATTACCTTTGAAGAATGGTGGGTAATTTACCCACCAACCAATGAAAATGAACAATTTGTTGGTGGGATCAAGATAATTCATGAATACCACTTAAAATGTGCTTATGTGGCTAATGTGTATTGGTTAGGGTAAATTACCCACCATTCTTCTATGGGTACCCTAATTGTCACCTTTAACAGTACATTCTATTGAGAAGGTTAAGTCCAAGCAAAAGACTAAATTGAGAGAAAATGAGTTATTTGAAAATGATAGAAGGAATATTACGATACAATTAAGGCAAAATACACATTTATACGGTGATCTCAAGTAACTAGCATAACAAACATCCACCTAGTTATAACAAACTTTTAACCCTTAAAAAACCAATTCTAACAAATTTTTAACTATATCTAACATATTCGTCAATTCAACATTTACTGGTATATTTAGGTGAGTTTTTTTTTTCAAAACTATTTTCTATCATTTAAAAAATTATAATAGCTAAATATTATTTACCAAAAGTTTCAGTGAAATGAAAATAAATTTTTCTGAATCTTTATATTCATAATAGTCAATATTGAATATTTTTTTAAGATAAAATGTAAAAAATTTATATGATACTTACAAACAATAAAATGATTTTTCCTAAAATACAAAAGCCAACAAATAGCTCTTTTGTTTAAAAAAATAATCTTTAATATATTAATTTAAAAACAAATATACCAAAATCATTCAATAATATGTGAATGTACACAAACTCCTTTGCAATAAACGTATCTTTGATCAACACAATCCGTAAAATAATGCAAGGAACCAAAATCATGCAATATGTGAATGTACTATACAAACTCCTTTGCAATAAACGTATCTTTGATCAACTCAATCCGTATAATAATGAAAGAAAAGTGATACGAAATAAGTCATTTGTGTAAAGCATCAAAACTTCTAGAAAACATATTTGTACAAAATAAGAAGCCTAATTGCTCTGTGCAAAAGGTGAAGTTACGTAATCCCATCTTCTTGGTGCCACATAGCAACTGAATTAATGCTCCTCTTAGAGGGCATTATGTATTTTTTTTCCCCGTTGAAACAGCACTTAGAGTTATGTACTTATCCTATTGAGGGACATTTTATGTGGTTTGCATTTAAGCAAATATTATCTACCTCATATAATGTATGGTTGGAAAATCAAGCACTTGTATTAGAAGAAAAAAAAATCAAGAATTAAACTCAAGTAACTTTAAATACATTAATTACTTAAGTTTTTTAAACTCAAGTGATTAATGCGTTCAAGTTAATAGTCATATAAAAAAATTGAAGTTAAATCTGAGTCAAAATACCTTTTCTATACGAGATTATTTATCTCACAATTAAATTTTAAATTACCAAGTCCTCATTCCCAATGCTCTAAAAAAAAAAAGTCCTCATTCCCAAAAAAAATTGAAGTATTAAAAAAGGTATGGAGGTGAAACTAAATATACACGTAAATAAATCAAGCATGTAAGCTTATAAAAAAATCAAGAATGTCTCACCCACAATTAAAATTTGTTATCTGTTCAGGTTAGGAATATGATAATGATGTTGGCTGGAGGAAGAAAGAAAAGAAAAGGAAGACAGTTAAAAAGCTAAGGAAAAAAAATGAAGAAAATGTCATAGCAAGTGCTACTTGGAACTTTGGTACGGTAAAGAGACAACCCCTCTTCATTTTTTTTTTTTGTGGCAGCCGGGTTCGAACCCAGAACCTTGCATATTTTATTCATTGTTCTTACCAACTGAGCTAAGTTCACGAGGACAGACCCTGTTCATTTAGCAATAAGGTATTGAATTTGCAAGTTAAAAATATATTTGATATTTTGATTAAAAAAAGAATTTATTGATATGCAAAAAGAACAAATAAATATTATTATTATTATTGCACTTCTATTCAAATGCTAAGAAATGCTCTAAGGAGATTTGTTAAGAAGTTTAAAGCGAAAATTTATTCTGAAATTATGCATTCAACGCATTGAAATAAAAAAAAGTAATTTTTTCTAAATAGTTATTTTTTTTTTCATTTTTTAATTCTTAACAAATGTGTTAAAGACACTTTCTTTAAAAAAAATATCTTAAAAGATAAAAAGAGAACATAATAAAATAATATTTATTTTTAAATTATTATATAAATAAGTATATCCAAAAGCTTGTACACAAACAAGTCTTTCTTATATATTGTTATCTCAAACAGATGTTTTGCGGCTTCGTAAGGTTTATTGTCAGCCACAAAATTCCCATTGTCTTGTAGTGGGGACAGAGTAAATTGTTTAGCTATGATTTGAATAAGCGGTTCATGCAAACCCGATATATTGTGTATGTCTTTCATGATGGCGGGGTCATATAGTTAATATATGAATCATACACTTTATTAAGTCTGGTCTTGGCAAGTGCAACAAGACCTTTTGCATAGGGCTTCAAATTTAGAGGGTACTCAAAATTTAAAAAAGAAAGTTTTTTTTTTTTTTTTTTTGTATATATGAAGAAAATCAGTCGGTAAATGTCTTTTTTTTAGGTAAGAGTTTGAAATACAATAATTTTGCTATCATTTATACATTGTTTGTAGGTAAATATATATTTTTTTTATAGGTAATAGTCATGTATGAACTATTGCTCTTACATTTAACTACAACGTAGATGTTTGTCAATATAAGTGGTGTTGGATTTTTTTTAAACACATTTTAAACGAAAATTATCAAAATTATAACGGGACCTCCGAATTATCGGGGACGGCCCTGCATTCTATAAATGAGTCTCATATAAAATAATGATGCAATATATATAAAAAAATATTAAAAAAAGAGTGTTAACACTACTCTTGTTTTACTTTGCGTCTACAAATAGTGTATTTTTCTCTATTTTTTGGTACCAAGTATTTTTTTATCTATTTACTGTCCCCTTAATAAAAAAGTCTTGGCGGTCAAACAACTCAATGATTGCAAAATCAATTAGCATATCATGGCCTTCTAAATCTTACTCGATTGATTTAACGTTTATGATGCTACACTGAGAATGATTGCCCCAAGCACGTGCGCTTCGATACATTGGCAGTGTGTCTAGCAAAATTTTTGAGGGATTCTCTATATTTTTAAGCATCATGCTAACGAATGTTTAAATGATATTGTTTGAATAAATTTTAATTAGAATTTTTTTGAGAGACAAATTAAAATAGAAATTTTATTTTGAAAATATTAAATATAAGTTAAATATTTGTCAAGGCAATAAATAATATTCTTTTTATGCAAAAAAAAAAACCAAATATTTAGGTAACGACGACCCAATAGTTTCGTAAAGTTTAGAGGTGATGATTTATTTTTGGGGTCTCACAAAAGAGTGGACATTGGAATATGTTTATGAGATGAATTTGACATGTTTATGGGAGCTAAAACTATATGGTTGCAACCGATTATGTCAATTGATAAAGGAGAAGCTTTAGAATTACTAGCAGCTATGAAATGGGTAAGAGAACTAGAGTTTAAGAAGATTATTGTTTGCTTAGATTCAAAAGTAGTATAGTAGACTCGTTCAACACACATGTTCGAGATGACGCGGAGCTTGGTTCCATCCTAGCTAGGTGTAGAGTTAATTTATCTGATATTCGTAACAACTCTTATGTCGATTTTTCTAAAAGAGATGCTAATATGATTGCTCATAATCTTGCAAAAGCGACCATATATAATGACAATTCTCATCTCTATTTTGATATATACGATTGTATTATTCCTTTGAATTTTAATGAAATGAATTAGCACCTTTCCAGAAGAAAAAAAAAAGGTGTGAGGTTAATGACATTTGTGTGCACATGTATTCAGTTCTATTTTTTATTTTATTTTTAAGATAAATTATTAGTATTAATTAATAAGTTGAAGGGAAAAAATTATGATAATTTTTTTAAGAGAAAGCTTATATTTAAGGACTATTTTTTAAATAAAGCTTAACATTTGTGTATAGATGTACTCACTTCTTCCCTAAAAAAAACAGATGCACTCACTTGTAATTTAAATAAAGCTTATATTTTAGAACTATTTTTTAAAGAAAAATTATATTAGAAACAGAGGAAGTAGCTAGCCTCTTATTTATGCCCTAAAAATACTATTTGGGATTTGTGGTCTGTATTATTGCAAGAAGTGGACATAAATTTGGATAACTAGCTAGTCACGTCGTTAGGGAAATAGTACAAATATCGGCTCTAGAACACACCAATATTTTCGTTGTTGCATTGTTGGTAGATCTAGAACACACCAATGTTGCATAATTACTAGTTAGGAGCAGATTGAATAATAAATAAACACATCCTTTTGAATCATATTTCCATTTATGTTTGTCCTACCTTCAAAAGGCACGTCGAAATTATAATTCGATTATACACGTGGATCCTTACTTTGATGGAATTAAGCCTAGACATGGCTCCCTATGTTTTGTATAATGTAACAGCTTATTATATAAACAAAATCTTATCTATTCAAATTTGAGTGTGTTTTTTTGTCAACTCGACGTGGCATTATTATACAATACTATTCATGATTGGTAATAGTTAGGAATATAAAGATATCCGTGTGATATTATACTATACGAAAGTATTAAGATGAGAGCCAGTTGGAATGCAAAAAGCAGACAAAGAAACTTAAGAATTTGTCACTAGCAAACTGGAGTTTAGCTAGCTTTACAGATTCACATGGTTTTAGCTTATGAAACCCTAAATATTTTTAAATGGTTTTCTATAATGTACGGTTTAGTACACTACTACTTGGTTGTGTTGTGCTGTTACTTTGGACTTGTTTATGGGCACTTAAGATAATTAGGTAGACATGTAAAAAGCTAAGGTTAGAACCAACAATATCCAGCTGGGTTGGTATTGACCTTGTTTATACCTAAAAGGAAAATCAAATGCATGTTGGTGGCTGCTATAGTTACACTCTTTAGCAAGAAGTAGAAATCCCCAGTTGGATCTGTGTCATAGCTTAGTAGTTACTGAGTAGGATACAATGATTGCCATGCACCTGTACACTGTAGTTTCCGCACAGAATCAACCAAAGTGGGCGCAAACTGCTGTTGCCTATTCCTTTTGTACTGGCCAATACTGACCATTGGGAATGGGTTTATTCAATCTTTACCAATCCATTCATCAGACACTAGTCTACTTTTTACTTAGTTCGGTTTTAAATATAAGAAAAATTCGAGTAAAAAATAAATGTATTTGAATCAAAATTTAATTTTCGTTGATTCAATTTTATCTCATACTCTTTTCGGTCATATTTATAGACAAAAAAAAAACATTTTAGGTTCGTTGATTACCTAATGTATTTGACTTATATATAGACCAAATACATTAGATATTAAATGGATCTAAAATTATTATTTTTTTTGTTTATAAATGCTATCGGGTGAAGTATATATTTAAGATTGGAGTGAGTAACTCTTTTTATAGGATTTCTAATAATTGGATAAGGATGTTTTAATAAAGGAGAATGTTAAACGGTGGATATTAGTTAAGCAACCAAACCAATTTTATTTTATAAAAAATAGTGTAATTATTACTTAATCAAAAATCAAAACTTATATTTTTAAAACAAATTTTCTATTTATAGTTTCCTTAATCATTGTCCTGAGGACATTGGTTCAAGACCCTTTAATAAATGATAAATATTTACAATTGAAATCAACAATATTAATCATTTCCTCAATACCTATGTAAAACTCAAATGTGACACCTAATATGAGACAAAAGTAATAATTTATTACTCCCCCTGTCTCATTATAAATGAGTCATTTGCTCATTTCACACATACTCCCTCCGTTTCAAAATAAGTGTCGTTTTAGCCAAAAAAATTGTTTCAAAATGAATGTCACTTTCGGTTTCCAGTGCAATACTAATAACTTTTTCTTTTCAATTATACCCTTCAATTAATATTATGTTACATTACTTCCAAAGTATTTTTTTTTCTTTAATGAAAAAGAAACCAATAGTTGATTAGGATAATTTGGTAAAATTGCTATGACATTTGACCACTTTATCTCAATCCTTAATATGTGTGTAATTGGCTAAAGCGACACTCATTTTGAAACGGAGGGAGTATGAAGAAAACATGTATAAGTGAAAGAGAGAGAAAAATGGTTTTGACTATCTTTGTCAAGTATTGATGCATTATTCTTTATCATAAATGTAAAGTAGAATATATTGAATTGAGAGTTGTGAAATTAATATTAATTAGAGTTATAATTGGAAAATAATCATTAGACATAACACTTTTACTAAACTGCACTTATTTTATATGAAAAACTCAAACTTAAAGTTGCATTGAAAATTGTGTGAGAAAATGGTTTGAGTATTTATTGAGGGAAAAGTTGGAAGAAAAAAAAATTAAAGTTGTATTGGAAATGTAAAGTGACATCCATTTTAAAATAATTTTTTTTAGCTAAAGCGACACTCATTTTGAAACGGAGAAAGTGATTAATATTGTATTGAAAAGTGAAATGGATCAATTTTTTGGGACAATATTTTTTGCAAATGACTCATTTATTATGGGACGGAGGAATATTTAAATTTAGAGTTAAATATATTTTTAAATCTAGTTCACATATATAGTTTTTATTCAATTTTAGTTATTTTTTGAGAAAGATTAAGTTTAATAATAAATAATTGGCTAAATTACATATTTTTTAGTTCACTTTGGTCCTTTAAGTCTTTATTTTTTTCATTTTGGTCCCTTAAATTACAAATGTTATATAATTTAGTCTTTTAAGGTTTTTTTTTTTTTTTTTTCCGTTTCAAATTTATCCGTCATGTTATTAACGTAGGGGAGGGGAAGGGAAGGAAAGGGAGAAAGGATGGAAAACTTTCCCCTTGTTTAGGAGTTCAAAAACCAACAAGGAAAGGAGATGAAGGGCTTATGTTATAATTTTACTATTTTACCTTTTTTCTCTTAAAATCAATACATTGTGTTATACTTTGTAATTTATTCAAAACAGTTTATCTCATGAAAAACAAATTATTACGATCTCTTTTTCAAAAACAACTTATTTATTCAAAACAGCTTATTACGACCTCTTTTTCAAAAACAACTTATTTATGCAAAACAGCTTAATACAATCTCTTTTTCAAAAACAACTTATTCAAAACATCTTATTTATCTAAACCAACTTATTACGACCTCTTTTCAAAAAAACAGATTATTCAAAACAACTTATTACAATCTATTATTCAAAAACAACTTATTCAAAACAGCTTATTTATGCAAAAACAACTTATTTATCCAAAACAGCTTCTAACAATCTCTTTTTCAAAAACAACTTATTCAAAACAACTTATTTAGGTAAAACAGCTTGTTACGATCTCCTGTTCAAAGACAACTTATTTATGCAAAACAACTTGTTACGATCTCTTTTTCAAAAACAACTTATTCAAAATGGCTTATTTATCCAAAAAAAGCTTATAACGACCTCTTTTTTAAAAAAACAACTTATTCAAAACAGCTTATTTATTCAAAATAACTTATTACGATATCATTTTCGAAAACAACATATTTATACAAAACAACTTATTCCGACCTCTTTTCAAAAAACAGCTTATTCAAAACAACTTATTTATGCAAAACAACTTATTACGACCTCTTTTTCAAAAATAGCTTATTCAAAAAAACTTATTTATCCAAAACAGCTTATTACGATCTCTTTTTAAAAACAATTTATTCAAAACAGCTTGTAATATGTTGTTTTGGATAAATAAGCTATTTTAAATAAGTTATTTTTGGAAAAGAAATCGTATTAAGCTGCTTTGCATAAATAAGCTGTTTTGGAAAAGAGGTCATAATAAGCTGTTTTTCATAAAAAAGCTGTTTTGCATAAATAAGATGTTTTGAATAAGCTGTTTTTTGAAAAGAGGCCGTAAGAAGTTGTTTTGCGTAAATAAGCTGTTTTGAATAAGTTGTTTTTGAAAATGAGTTTGAAATAAGCTGTTTTGGATAAATAAGTTGTTTTGAATAAGCTGTTTTTGAAAAAGAGGTCGTAATAAGCTATTTTTCTTTAAAAAACTGTTTTGAATAAGCTGTTTTTTGAAAAGAGGTTGCAAAAAGTTGTTTGGCATAGATAAGATGTTTTGAATAAGCTGTTTTTTGGAAAAGAGGTCGTAATAAGCTGTTTTGCATAAATAAGCTGTTTTGAATAAGTTGTTTGTGAAAATGAGGTCGTAATAAGCTGTTTTGGATAAATAAGCTGTTTTGAATAAGCTGTTTTTGAAAAAGAGGTCGTAATAAGCTGTTTTTCATAAAAAAGCTGTTTTGAATAAGCTGTTTTTTGAAAAGAGGTTGCAATAAGTTGTTTGCCATAGATAAGATGTTTTGAATAAGCTGTTTTTTTTTAAAAAGAGGTCGTAATAAGCTGTTTTTAAAAAAGTTGTTTTGAATAAGCTGTTTTTTGAAAAGAGGTTGCAATAAGTTGTTTGCCATAGATAAGATGTTTTGAATAAGCTGGTTTTTTTTTTGAAAAAGAGGTCGTAATAAGCTTTTTTCATAAAAAAGCTGTTTTGAATAAGTTGTTTTTTGAAAAGAGGTTGCAATAAGCTGTTTGCCATAGATAAGATGTTTTGAATAAGCTGTTTTTTTTTTTTTTTTTGAAAAAGAGGTCTTAATAAGCTGTTTTGAATAAGCGGTTTTTGAAAATGAGGTCGTAATAAGCTGTTTTGGATAAATAAGGTGTTTTGAATAGGCTGTTTTTGAAAAAGATGTCGTAATAAGTTGTTTTGCATAAATAAGCTGTTTTGAATAAGTTGTTTTTGAAAAAGAGATCGTATTAAGCTGTTTTTGCATAAATAAGTTGTTTTGAATAAACTGATTATTTTAAAAGAGGTCGTAATAAGCTGGTTTGAATAAATAAGCTGTTTTGAATAAGTCATTTTTGAAAAAGAGGTCGTAATAAGCTGTTTTGCATAAATAAGCTGTTTTGAATAAGTTGTTTCTGAAAAAGAGGTCGTAATAAACTGTTTTTAATAAATAAGCTGTTTTGAATAAGCTGGTTTTTTGAAAAAGAGATCGTAATAAGCTGTTTTGCATAAATAAGCTGTTTTTTTAAAAAGAGGTCGTAATAAACTATTTTGCATAAATAAGCTATTTTGAATAAGTTGTTTTTTAAAAGAGGTCGTAATAAGCTGTTTTGAATAAGCTGTATTTGAAAATGAGGTCGTAATAAGTTGTTTTGTATAAATAAGTTGTTTTGAATAAGCAGTTTTTGAAAATAAGGTCATAATAAGTTGTTTTGTATAAATAAGTTGTTTTGAATAAGCGGTTTTTGAAAATGAGGTCGTAATAAGGTGTTTTGTATTAATAAGTTGTTTTGAATTAGCGGGTTTTGAAAATAGGGTCGTAATGAGCTGTTTTGTATAAATAAAAGTTGTTTTGAATAAGTTGTTTTTGCAAAATATTGTAATAATTCAGTAATGTCTAAATTTGAAATTTTGAATTATTATGAGGGTAAAATTGTCAATTTGTATGTTTAACCCCCTAAAATCCTCAATTTGGGGGAACTTTAAAATTGGACAAATGAAGCCCTTCAAAACCCCCCAAAACCTTTCCCTTATTTTTTTAAAACTCGCAGACAAGGGTTTACCATTCCATAAGTCTTTCCTTCCCCTCCCCTCCCCTCCAAAACCCAACTCGCAAACAAAGCCTAAGTTACAAATATTAAGACATTTGTATCCTTAATAAGAATGACTAAAAGTTTAAAATGTTTGATGTTGATAACGTAAAAGATCAAAATATTTAATGTTTATAAGTTAAGTGAGAGAAACGAAATGATTTTTTTTTTTAAAGGACTAATATATCTAACGTATTTTAAAGTACCAAAATTTAAGGGCAAAAAAAACTTAAAGGACAAAAGTAAAACCTACAATTAAATTAAGTAACAATTTAGCCTAAATAATTTGAGTGCAAAGAAGATATATTAAGCTATAGGATTATGGGTGGATCTGGACTAACAGTATTAATGGGGCAATTTTTTATCAAATAATTAAATAATACTAAATGTAATAAGAAGTTATACTAAAAATATATGTCACAATTCCAAATTGCGACATACCCCCTATGTCACAAGACCCAATTGCGACCTACCCCCATTCTCAAAGTTTGCATTTATTTTGTCCTTATTGTATGTCACAAGTGGGACTTGTGACATATTTATTTATCATTTTTTCTATTAATTTAATAGAATTAGTTTTAAAAATTTAAAAAAATTGAAATAAATATTACTAGGAAAAAATCTATTAAATTACTAGGAAAAAATCGGAAAAAATATTTATTTCAATTATTTTTAAAAAAATTTAAAACTAAATCTATTAAATTACTAGGAAAAAATCGGAAGAAAAAATAAAATTAAACATGTCACATACAGTAAGGACAAAATAAATGCAAACTTTGAGAATGGAGGGTAGGTCGCAATTGGGTCTTGTGACATAGGGGGTATGTCGCAAGTTGGAATTGTGACATAGGGTATGTCTCAAGTCCAACTTGTGACATATGGGTCAACTCTCTAAAAGTATGGTAGTTTTGGGACAAATTTTATGATACATCCAATATATTTGAGTGTACCGGTACACCTATTCTTTAAATTAATAGTTAAATAAGTTGTTTTTTGAAGAAAAATATTATTTTTTTATCATTTATAATTATAATAACTAAATCTTATTCATCAAAAATGTCAACAAAATAAAATTATTATTTTTTGAATTTTTATCACTCATAATCGAGAACATTCATTATTTTTTATGATAGTATGTAAAAAAGAAAATTACTATAATTCTTATAAACAATGAAATGATGTTTTTTCTTATGAGATGATGTTCTATAAAATATAAATTTTGACAAATAACTATTTATTACATAAAAAATGATTGTTAATTTATAAAATTATGACGTACACCTCACAAAGTGAGTGTACAGTAGAAGTTAGTATTTTTGTTTCAACTAGGGCATTTTTTGATTTTTGGTTTCATGGGCATAAAAAAATAAAAAAATAAAAATTCGGCCCTTGAAGAGGTTCGCCCCTGCATAGGATCCGAATTCAAAATGGATTGACCCACATTTACACTGTGTTTCTTTAAACCAAACTTTATTGGGTTCAAAGATAGCACTTGTTTTCCCTTTCTTGTTCACATACACCACAAGACATAGTGAAACACAAGTGGTGCAACGACATACGCACGCAATGCATGTTTGATATTACGGTGATTTTATTTAAATCAAGGCGATTCATTACAATCTGGCAAACTTACGGTGATAACAAAAATGCACTTAGTTATAGAAAGTGTGATTCATTTTGATAGTAAATTTTTGGCTTAATTGCACTTTTGGACCCCTATCTTTTCAAAAGTTGCGGTTATGGACCCCTAACTAATTTAAATACAAAACAGCCCCCTATGTTTTGTTTTTTTGGCAGTTTTGGACCCCCAGTCGATTGTTGACTCGGTCAACGCTGACGTGGCACCCTAAGTGAGGTGCCACGTGTCAAATTTTTTTTTTTTTTTTTTGCCTTGGGGGTCCAAAACTGCCAAAGAATCAAAACATAGGGGGCTGTTTTGTATTTAAATTAGTTAGGGGTCCATAACCACAACTTTTGGAAAGATAGGGGTCCAAAAGTGCAATTAAGCCTAAATTTTTTACTTTATGCAACTATTTGTTTTGATAGATATATCTTTTTTATTGAGAAATGATACTTGTATAACCATTTTTTATAACTTTTGTGACAACTTTTCCTCTGATACTTATATTATTCTTTACTTTATTTCTCTATTGTTTTGGTTTTTGTGCAAATGCCTACTTTTTTTTTGTAAATTTTAGTTGTTCCATAAGTTGTCAACCAAATGATTGTTCAAATAACACTCCTCTTTTTTATTTTAGTATAGAGAGACTTAAGATATGTAATTTTCTTATGTTACTCATCAATCATTTTAGAGGAACACAATTATTTGGTGATGAGGGTGAGTAAAATTGAAGTATATGGCTTTGTTTTAACAAAAAGGTATATGTCTATAAGTTGTTATTATTAACTATAGAAAATCTTAACACATTATCAATTATTCATCTTAGGATTAACGGAAGGAACACGTTTACATAATTACATAGTTAACCATTTTAGTTTGTCAAGTCCAAATTCACATCACTGATAAATATATGCTATACAAGACACTATTCAAATAACCATTCCAATCAATATTTTGGTTGGTCTATACATAGGATCCAACCATGCTAAAAGTGAGAGATGCCACCTTTGGAGGATATATTGTAAGACTCCATCTTGGAATGAGACATGAACTCTTGATGGCTGTGGACATTACTTAAGTCGTTAATTGGTTTATCATTACCTAACATGATTTGATGCAACAATAAACGGTGGATGTAGTAACTATCACAATCATGCATTCAAATTTTATATATGGGAAGAGAAAGGATAATCACAAATGCTACATAGTTCATCTAATATAATATTTTTGAAGACAAATTTGTTATGCGTTAGTGGTGAGGAAAATTTGAACGTTGCACCTTTTATGACTCTTAACTTAACTATTGTATTCCACACTCAACTACCAAACTACTCTTATGACTCTAAACTCCATGTAATTCCTCCTCTTTTAGATTTTGGCCCGATTCATTCTTCACGAAAGCTATGATGTGTTACACATGATTTAAATGATCATGTTAATAAGTGTATTAAGAACACTTCACACTTGTTAAGAAATCAATTTCATTAAAAATTGTACAATCAATTTTTAAAAAGCCTAAAAGTGTTATTTTTAGCGATTTTTTTTGCCTTCTTTAACAAATACTACCTAGAAACAATTGTTAGCATTTTTCTAAATTAAATGAATTTGTTTGGAGGTTACCAATATTGACACGTCATTTGAGCATAAAGTTGCAATATTTATTTTGATCATTTTCCATTATGAGATACAGTGTTCATTCAAAGCTAAATATTTTTAGTATTCTCTTCGGACACCAAATATACAAAGGAAAAATTAGGAGTATATGTTAGAAAAATATTTAAATAGTTAAAAAAAAAAAAATTGATTGAAGAAATTTTTGGGACGAGTCATAGATTAGGTCGCTCTTTTTAAGAGGTTTTGCAGCACTGCCCAAAACTGTGGAGCAGATTATCAACCACGACGTCCCTAAAATAAAATAGCTCAAATACAAATGTATTGTAGTCCTACTGCACAATAAGATCCATTGTAGAAATACAACATCAATATGGTATTCAAACCATATGAATATGACACTATCACTCTATCTTTCGAAAGGGACAATTTAACAGTAGAGACTTTTTTTAAAGGAATAAAAAGAAATAGGGAAAAGTTGGCCCGGAATGGCGTTCTGCAGAAAAGGGGAGAAGAGAGAACTCGTTGATTGTTAAGTTTTGGCGTGTCTAGAGAGTGAGGTTGAACACTCCTTTTATAGGGCAAGGATCCAAGATCGCTTACAAAACGGATGACTCATACCATTTGACCGTTCAAGAGACGGACGGTCCAGACTATGCAGAGCACATGCATTGGCGCGTGTTGGACGCATGCTGATGTGACGATGACATGTACTAAAACCGAAAAAATTCCAAACAATTTTTTAATTAATTCAAGGTTTCGAGTCAATAGAAAAGATTACACCTTATAGTCCATGCATCTTCATCATCTTGTTGATTGCATCATCTTCTTACAAAATTGAGTATCTTTTGGGGCACATCCGAACCCCAAGAGTCCTACCTCCACTACATAAACATTTATGTTGTGTGAAGTCTATCCTATATGAAACTTCCACTATGTAAACACTTGCGCGACTTTTATGAATTTTTTAAATCACACACAGAGACACACTTGTGTTCCAATAATCGCTTATGACCAATTCAAAATATGAAATAAGTAACATAAGAAATATTTCAGAAGACCAACCTGATCATCGGATTTTTATTTTAGTTTACATGAATATTACAAGTGCTTGCTTGCCGTATTTCTTTCTTCATAAAAGACCGGATTGGGGGACAATATGCATGGAACTATACATTATTCATCGAGCAAGTTGTTTTTTGTCTAGAAAACCCGAACAAAGTTTTTTATTAAACCTCAAAACATCACAAGTACAAGATGTACCAATGTTGTAGGGATTTATGACTTTTTCCATATACCAGCGACTTATATTTAAAAACCAATACAAAATCCAGAAATACACCAACAGAATAAACCGTTATGCAAATTGTGTTAAAAGTAACCATATATAGAAGAGATTAACAATTACAACATATCGTATATCATAGAATGTATTTTCATAAAAAAGAAAAAAGACAGATTACATGTAACGTGTATAGGTGGTTATGTACATTGTGCAATTTCAAGGCTATAAGTATACAAATTACTTATGAATTATGATCGTGAGTATTTAAATGGCCGGTGATGCAAATCATCACTCTACTATGTGACTAGGTAAGGTGGGACTACCACGGGCACAAGTATTTCTGTAATAGAATCATATACATTAGCCGATTTATACAACATAGCGACGAAGATAATCCAGTCGAGCTGAATGCTTGAGCTTCATAAGAGCCTTGACTTCGTGCTTTCTCACCATTTCCCTAGAGATGTTCAAGTTTGAGGCAATTTCTCCCAAAGTTCTGTCACCCTTACCATCAAGTCCAAACCTCTGTCTGATTACCAAGTTTTCCTTAGGCTTCAGGGAATCAAGCTAGAAAACAACAACACATATCTAACATTAGTTGCAAAGGGGGACAAATGACCATGGAAATATGATATATTTAATTATATATATTACTAACAAATTAGTATGACCTAAACCACACAATTTAAAAAGTAGTTCACATCTAATTAATGATTGGGTCACAATTGTCTATAAACTATGTTACATCATGGAAGGGCACAAAATAGGATTTAATGATACCGTTGGAAATTCCGCCTTAAATCCTTATTAGCAGTCCACCCGAAGCAGCCTTAATTGCATACTCCAACATCGTCATTGTGTGTTGGGTGTGGTTTTAGTCCCACGTTGCCTCGGGATATGACTGAAATAGTCATTATGGTTTCCAGAGTCCTCACATTACAAGTTAGGTTTGTGGGGTTGAAGCCTAAGCCCAAAAATTTTGTGATATGTTTTGGAGGACTAAGCCTATATGTTGACATGTTTGCGATTTTTTAAAAAAATATTGAAAGAATCACACAATAGATGATCATATAATATTTCAATCACCATTTTAGTTGATTTTAGAAACATTCAATAATTTAGAAATGAAAAATAAGTCTTCCCCTCTCTTTCCCTCCAAAATCCAACTTCAAAACATATAGCCTTAAGAGAAACAATGTTTAGTTTTTGACAAGATGTGATCATTACACTTGTTCGAACTTGGACAAGATATGATCATTACACTTGTTTGAACATATAGCAACAACAAATACCTATTGATATTTCACAAATTTAACAGATTATTTTTGTATAAAATCCAATAATGTTCACTGTTCACAATAATAAAATTGAATAAAATGACGTATTGTAATACAATACTAGTATCAAATCAAACAGAGACATAAAAGGTTAGAGCCATTACCACATCATCAAGAGCAAGCCTTAGTAGAGCAGGTTGCCTCCTGTTATCGCCATCAACACCACCATCATCAACGACCCCATTGATAAACTCTTCTTGCGTGGTTAGATGTCTTGAATGCAGTGAAAGAAGGGGTTTTGATGCCTTCATTACATCACGGTATCTTTCAGGGGATACATGAACTTTTTCTATTATTTCTTCCTCCGTTGGTGACCTCTGAAGCTGAAATGATAACTCAATCTTAGCTCTTCGGATCTCTGCTCTAACCTGCACAAAATTAAAAGATACCAGACACACCTGAATTAATCAATCAAGCTCATTTTTTATTTCTTAAGTTTCTTAAAATCCATATTTTCTTTGAATATCCTAGGCTTAAGTCTTGTATAGTTCTACCAATTATTGGCCAAAGAAAATATTGTTGGATGACATACAGATAAGTTAGCCCTTACAAGTAGCTGAGACTGAAAATGGAGTAGGTTTCTGCTAACATGAAAGATATATAAAACAAGAGCCCTGCTATTTCTAGCGAAGAAAATTGTTCCGAAGTATCACAAATCGACTTTCACTGTTAAATCTTCAATTTATTACAATACATATAGGTGGATAAGATATGAATAAATAATTCCTACTGCAGTTATTTTTACATCATCGTGATGTTGTCGTAAACAGTTTTCTCGGGACAAATAGCATTTCTCATAAAACAATTGAAGCATATGCTGCTAAAACTAAAACAATAATCAGCATGTGTGGTAAGAAGAAGAATACATACCGATTCAAGTCCAAAGGGAACACGTGAGAAGCTTGCGAGGGTCATGGAACGGATGATAGCATGTCTTATCCAAAACAGACTGTAGGTTGAAAGCCGAAATCTCCGGTTTGGCTCAAAACGATCAATTGATGTTATAAGTCCTTTAACTCCAGCCTGACAAAGATCCTGAAACCTTGGGCTATTGGCGAAATCTGAAAAATATCTGTTGATCACGAACAAGACAAGCCGGAGATTGTGCTGCAAAAGATCATATGACCACCATTTGTCAATTATTGATATAACTTGCTCATTCCAAACAATATCACTAAAATGAGAGGGGCAAAATTTAAAGATTACAAAGTCATCAGAAATTTCTACAAAATAGGATCTATTCCCATAACCATGTAAACTCAACTTCATGATTTAACTATTATTATAATGTAACTACTATTGCTGTGAATATTGGTCAATTGAGTTTCTCCATCGAAGTTAGAATGAGATAGTGTTCCCACGAATTCGCCTAATACGACTCTAGATACTCTATTGAGGACTAAGTCAGTTTTCAAGAATAGACAATGAAAATGACTGTTACTCAGTCCTAAATCCCTATCATAAGTTGAGTTGACTAGTAGCAGATGAACTCATTAATTAGATGAATAGTTCTTGTTTAGTCAGAGGTTCGCCCGAGAGCTTAGGAGAGTATGCAACCCCTCAGACCCTCAGCCATGACCATGAAGTGAATGGGACTCACAATTGGCCCACAAATTTGGGAGGGTACAGACAGGATGGATAACGACACATATTGAATAGTTAATCTTTAAGTTAAAACTAGTAGAAAGCCAAGCTGTAAAAGAATTGAACAATTTTAATTACCTTTATTAGCTTATTTCTTGCAGCTCGACCAACCTCTATTGCTTTCTTTACTTGAGTAGTGTGCATGTTTGTTGCGTCGGCTATTTCATCCTCTGTGGGCTCTCTTTCTAGCTCCTTTTGTAAATCATCTTTCACTTGAAGAAGTGCCTGAAAATTGACAAATATATCTTAATATCAGAAATAAAATCAAATTCTGAGTTTTTGCCTAACATCATTGACCACTATATTGGAAATATTATTGACATGGTATCAAAAAGCCTTGAATGCCTTGTTCATCAAGTCGCTAGAAGTGGACTAATTGTGAGGGTTTTAGGTTTTCAGGAGGTTACAACTTACAAGTTCCAAGTGCCATCATTAACAATATGAAAAAAAAATAAAAAAGAAAAAATGAATGACCAATATGGTCAAGATGTGGATTCTTGACGCCCTCATTCTTATTATATGCATGAATTTCAGCATAGATTATAAGACCTTTGCTTGATTTGTCCTTCAAGTTCAGACCTCGGAGGGAGTAAAACCAAAGAAATATTTATGAACCTTGACTTGCCAACTTAAGCCATCGGGTTTTAAACCATTAAGTTGAAAGCTTTCTTGCTTCTCAGCAATGAAAAGATCTAAACTACTATAAGAAGAGTAAAACCAAAGAAAGTGTGGTCCAGTGATGAAATTATAGTAATAAGCTGCTCACCTTCATTGGTTGCATCAACTTGAACAAAAATGCATGCTCCGAAGAAGGAAGAACTGGAGGTATTTTCATTTTTTTCCAGTCCAGACTGACCAAATCAGCTGGTACTGAGTATTCCCTTAGAAGTTCGTCAATCTTCTCAACTCTACTCCTGGGATTTCTTTTTTTCCGAGTAGGAATGACATCTTCACTATTTTCGCTCGTTTTTAACGCAATCCTCTCATCAAGATTCATCCGTTTGGCTTTCGTTTTCTGGTTTCTGACCACCCTATCACTGTTTGAATCCTCTTTACTTACATCACCAATCTTCTTACCCCTTCGAGAGACTCTTTTGATCTTACGTTCTATATAATCTGCATCACATATATCGGTTGTCGGGCTAAGTTTGTATATATTTTCAAGTATGGCAGCAGCTTCATTATAATCCACATCCAATGAAGATGGAAAAGTTTCCTCAGTGCAGACGGCTCTTGGTTTCTTAGGTAGTTTATTCGTTTTTGCTATCCTTTTCTTGTGCGTCTTGGCTGGTTTAACTTGCGTAGGAATTTTCTCTTGAGTCGCAACCAACGCTGTGTCATTTTGTTTATCTCCTTTAAATGCTACCGTTAACGGTCTCTTCAATACCGGATGGTGAGTTGAAAACTTTGCATTCAATCCTAGTGGAGTCCGAGCAGCTGAACTAGAAACAGTCACAACTCCCATACCAAGTTTGCCGAATCAGTGTTTAGAAAGAAATTCAAATGACAGTTTCTCAATGCCAAGTTCCTGCAACAGCACAATGCCATTCAATTACCAAATAACTCAAGTACATAACTATTGCCATTCAATCCCTTGATTAATCATTCAATTTAGCTTCAAATATTAATACCAAAACAATAATATATGGAGAACAAGTTAATATATTACTTTACTAGCTAGGCACAAATACCATTCATGCATCAGTAAGATTCTTCAATGTTCAAACCCCTATCACATACAATTTTGTAGGAGAGATCAACAATCTCCCTAACCAAATAAGAAATTTACATTTTAAATTCATAGTTATCTAGTATTTTTATAACAATATTCATTTCAGTGTTTCCTTCTATATATAGTAACTGGTAGCACCTAAACAATGCACATGCAAACACTAGACCAAATTAGAAAGGAAAAATAATTAATCTATAATCCATAGCTTACTTTCAAATTCAAATTATCGATTGCTTACTCAATAATTTATTGATTTGATATCTTCTACTATCAATTGCTTATTTCAAATTACAAGTTTCACAAACAACACCATTGAATTAAGCTACCATTTTTCTCTATTCACTAATAATCAGTGAAAATAAATCAAATTAAAGTAATCAAAATCAAATGATCAACTTAAAGAAACACATATTGAAAGAAAAACAATGAAAAATAGAATTGTACCTTTGATCTCTGAATGGAAGAATCTAGACAAAGAATCTAATGGAGAATGAAAGAGAAATTATATGTGTTTGAGGTTCTAGTATTTAACTCAAATTCGAAAATTACGGTAACCACAATTTATGTCTTTGAAAAATCAACGGTTAAGAACTAATGTCAATGATATCTACGGTGAATGAAAAGAACACGTGAGCTGTGATTTGGAACACAAGTGCTGACGTAGCAATGTTAGAAAGAAGATAGTGTTGTCGTGTCGTTTTTGGAGTGGAGGAGCTGATATTTTGCATGAAGAAAAAACAAATGAAAATTGTGGATCATAACTTTAACACGTGGCTGATGAAAAATATTTCATTTCTTTTTTTCTTTTTTTTTTTGTGACACAAAAATTATATAAGAGGTGCAATTTTGGATACGTAGAACATTACGAACCATGATATATTTTTATTTTTGTTGTTGACGAAACGAATAATGATCTGTTGTCCACGTTACTTCTGTCCATCCATGGCCTTTTCCTTTTCCAAAACACAATTTTCGCAATTAAAAAAAAATGTTCGTGATAATTTTTTTATGACATTTTAGTTTCTTTTTTAATTATCAAAATTATTATAAAAAAAAAGTATTTTTTTTAAAGATATAAAAAATTAGTTAGATCGTGTGAGATTAGATGATTAACTTAACCCTTTAAATTGTATCTTTTCCTATCACATCATTATCTCTTTTTCTCTTAAGATGTATTTACTCGTACGAAATGTACATCAAACATTTTTCTTAAATTAATGTATTTCATCCGTCAAAAGAAAACTAATGTCTTTCAATAAATTTTAGTACTATTGAATTATGAAACCTAGTTTTGACAAATGTTTATATAATTTAAATTGGATCAACTCCTTCACTAATATCTACATCTTGATAAAAGTTTTAGAATTCAACCATAGATCAGTAGATACAAGGTATAACATATCAGTAACAAGGAAGGAAGAAGAATTTGTGTACCTTGAATTATGTTGATGAAGGATAACTGCCATGAGAGGAATGACTACCCTCATTCCGTCTAGGTTTGCACCATGCTGGTCAGAATGTTTAACCGTCTAATGGGATGACGTTTAAATAGATAAACGGCTGAGGGCAGGGACCTCTCATTAAACTTAGCTAAATGGTTCAACCTATCATGGTCCATTTAGAAAGAATAGCACAATCATACATATTCATCAACTAATTAGTGCTTAACACAATAGACCATAATTTATATTATAACATTTTATAATAATAATTGATTATTGTCAATCCATAATTGATTAATTAAATAATTAATCCAACACATCTATCTCCTAATTCTCTATCTATTTCTTAATTCCATCTCGTTCTTGATAATTTTATTAATTTTAATGAAAAGAGAGTGAGATTAAGAGAGATGGAGAGTTAAGAGAGATGTAGAGAAATAGTGAATGAAATGATCCAAATCAAAAAATGCTAGAAGCCTAAAATACTTTCCTTCCAATAAATGCACATCTATTTTTTTAACGGCATAATTTGCTTATTTTGGATAGGCTAATTAAAGTTGATTTAAGGGCCGACCTAACACATTTGAAGGCCTTAGGTTAATTTTTTAGGGTATGTTTTGTTGACGAGTTTTAAATTTCAAGTAGCAACCTGCTATTAGATAGTTTAAATGAGAGAGCATTTTGGTTATCTGTTTAACTTCTTTTTCAAATTCAGAAATTTCAAAACACAAATCTTAAAATCCATATATCCATCACGCTATTTGATGCATAATGCTCCTTGAATTTTGTAATTCATAAGCAAAATGCTTCACAAAATTTATATATCTCGTAAGTAAAATTTACTTCAAATGATGTGTCATCAATTTGGACAAATCAAATCATCGGTTAATGTGATACATTAACACTCATAATAAAGTTACTTGAGAGATATACTAATATTTTAACTGACGTTGTTTAATTTAAGGGAACAATTTAGAATTGTGTAAATCTTGAATCTCAAATTATCAAACGCTCACGACTTCATGCACTTAATTTGATAGTTTATTCAAATCAAAATTAACATCTTTCTAATTCAATGGAACTGCAAATGTATAAAACTTAGAAAATCTGGAATGCAAGAAATGTAGAACATTAAAAATGAAATTCTACCTTGCTATACATTGATTAAGAACACTACACTTTTAGACAATAATAAAGTTAAGTACAATTTTTGTAAAAAAAAAAAAGAAAAAAAAGAAATTAAGTTCAATTTTTACAATCCCTCAAAAAAAGTACAACTTTTACAACAGCAAAAAGGGATAGTTGTGTTCCGAGCTATATTATGAGTTGCTACAAATTACCTGAAGGTTGTTGTAATGAGATTGAAGGTTTATTGTCAAAATTTTGGTGGGGAGCAAAAGAAGGAGAACGGAAAATTCATTGGATGAGTTGGGAGCGATTGTCCAAGGCTAAGACCAAAGGCGGGATGGGTTTTCGAGGTTTTAGTGATTTCAACAAAGCGCTTCTTGGAAAACATTGTTGGAGGCTCCTGACCGGCGAAGATACGCTAATGGGGAAAGTCTTTAAAAGTCGGTATCACCCAAGGGGAAGTTTTTTGGAGGCCAAGATGGGTTTTTCTCCTAGCTATGCTTGGAGGAGTATCATGAGTGCTAGAGATGTAATTGAAAAAGGTAGCAAATGGCAAATTGGAAATGGAGAGAAAGTCAGAATTTGGCATGACAACTGGCTTCCAAACAGAGGCAATTCAAGAGTGCAGAGTCAATCTACAATACTCCAACAAGATGCATATGTTTGCGCTCTTATTGATCAAGACACCAAGCAGTGGAATAGAGATTTGATCTTCTCCGTTTTCAATCATTTTGAGTCAAGGCTCATTGTTAACATTCCTTTATCTTGTAGACTTCTAGAAGATACTTTGATTTGGTCTGGAGAAAAGCATGGGAATTACTCCTTGCGTTCAGCTTATCACTTGTTAGGCGAGGAAAGAAAGAACGTTCTACCGGGATCATCACACGATGCCTATGAGAAGCTGTGGAAAGAAATTTGGCGTGTAAATCTCCCAAATAGAGTTAAGAACTTTATCTGGAGGTTGTCACAAAACATCCTACCCACCAGAGGAAACTTGTTTAAAAAAGGGGTTAAAATTGAGCCTTTATGTCCGATGTGCAATTCTGAAACTGAAACAGCTCACCACCTCTTCATGGAATGCAATTTTGCTAAGTTAGTTTGGTTCTCATCTAGCCTTGGCATCCATGTTCTGTAACAGCCCGTTTTTTAGCTAGGTTTATTTTAATTACTTTTATTATGTGTTTGTGTGTGATTATTTGTGCTTCTGTATATTTAATTGTCATCGGGTGCATTTACGTGGGTTTTCGTATTAGGGGGGTATTTTGGTAATTTTGTGAGGATGGGTAAAATTATAATTTTAGTGGGAATTGCTTTTAGTAATTAGTGAGAATGGTTATTTCATTAAGTTACTAGAGAGAGTCGAGATTTTACCGTTAGTGACACTTTACCGTTATTAATTAAAATATCGTTTGGAGTGTAGTAATATTTTGGTTTGAATAGAAATGGGTTAAGCCCACTAGAAACTAAGTTAAGCCCATTAGTAGCGATAACACTAGGGTTGTGTTAGGAGAACCAATTCATTCATTTCACAAACATTTCTAGAGAGAGGTAGAGAGAGAAAGAGGTGAAGAGAAGAGCTTTAGGAATCAAGTGGGTGACTTAGGAGCTGAATTGAAGCAAGGATTAGGGTTAATCTTCTTCAAAGGTAAGGGGGTTAGTTATTATCACAATCATGTAATTTTTGCATCTACTCATGTTGTATGAAAATGGGTTGATGAACAATTCATGCTAAATTCGTGCTCTTGCTGTGATGTTATGTTTGTATGCATGAATTGATGTTAGTTGTATGATTGTTGGTGGAATTACATGTTCATATATGCAAAAATGATAAGTTATGAATATTGTGCTCAATTGGTGAATTTCTCCTAAGTTGTTGTTAAGTTGAGATGTGATGCTTGTTCAAATGATGTTATGAATGTTATTTGATAATATGATTAATGAATAATTGCTTGGGTTTGCATATTCATGGATTGATGATGAGAATTTGAGTTGTGTTGGTGTTTTGGTGAAAATGAAGAGTTAGCTCAAATGTCAAGTGTTTTAAAGGTTGATTGTGCCTTTATGAGTCTTTTTAATCATAGTGACCTGTAAACATGTTCTGGAAACATATTTTGAGATTTGGGAATCAAATTGGGGAATTTTGAGTGAAAGGGGTTCCAAACCCGTAAAATTTCTGCAAACCTGTGAAGGTTCACTTAGAGGTTCGCTTAAGCGACCTGGTAAGCGAACATTCATAGTATTTTTCTGGGTTCAGTTCGCTTAAGCGAACTGTGAGCGAACGAGTGAGCGAAGATTTCTGGTTGTTACTGGAACTCGTTCGCTTAAGCGAACATGTCGTCGCTTAAGCGAACTGGTGAGCGACCAGTCAGCGACCAGAAAGCGAACAAGGCGAGTTGCTACTGTAACTTGTTCGCTTAAGCGACCCTCTGGGTCGCTTAAGCGAACAGCTTCAGTTCCAACCACCTTGATCTTTCGTTCCGGTCTTTGGGGACCAAATCCGAGTTTTCTTAAATGATGTTTTAAACATGTTAAACCACTGTTAATTCCCTAAAGCCTGCTGGAACGATGAGTGTTCGCATATACTTGGGATTTTTGAAATGAGTCTTAACTTGTGAGATTTTGAGAGTTCCAAACCTTGTCGAAAACAAATTTTGTAATCCAATGAGGCTTGCAAGTAGACCTACAGCTCATATAGACTTAGGTGATGCTTGCAAGGGTGGCCAATACCATTATCAAAGTGAAATGATATTTTGAGTGGGAAATGAAAGGTTGTGAAAACGGGACTCCTTGATGAACTTAAGTTGTGCTTGGTCTTGTATGATAGTCTGAAGACGACTTAACTTCATGTAGACATTATTGGATAAGATTGGTTAATAGTGTTCGACTTGTTCTAGTTGTTTCGTTCCGAGATAGTGTGGTGAATTATTCATGTGATAAGTGAATTGTGTGAAAGATATTGTTGATTGTTGATAATCAAGTTGTCTGTGTGATGATGAATACTATGATTTAACTGTGTGTGGGTATGTTCTCTTGGTAATGCAATGTTGTGGAGATAATCAATATAATTGGGTGTTGTCCTATGTATTGAGTTGAGATTGAGAAATGTTGTCGCATTATCGAGTCATTACACATGTCCATGCATCATAGTCGTTGTTGCTGTAAAGGGGATGACTCTTTTACTTCGAGATTATTGTAAGGCAGGTGTGAGCCCTTACAATCGATGTGCAAGTGGCATCGAAAGGTGACGACCTTGTTGAGATTTGGTACCGCATGCATTTATGTGTCCATAAGTGCATATCATAGCATGAGTCCTATGTGAATTGGGTGATTGGTGATGTTTTGAGATGAATGAATGTCGATAATGATTGTCTATGATTGATGTTGTGAATGAATATTTATGATTGGATAATTATTCATGTGATTGATATATGTGGATACAAACTATCAAGTTGTGGTATAAGTGTTTATGCATGGCTAATATTATTCAAGTACATGATATTATTTGATTTGATTATTATCTGGATTATGATAATGTAATGCTTACCCCCAGTGGTTTTAACCGCCTACTTGCCTGTATGGGTGAGTAGACGTTGTGCAGGAGTAGTCTCAGTGAGTTTTTGCTTGGGATATCGGGAGCTTCCTCCGATATCGGTGTCGTGTCGGCTCTGATCTAGGCTTGTCGTGTCGGTCTAGATTAGGTTGTTTATATTTTTATTTGGATTATTATTTTGTTGTTGACTACCCGTATGTTTGGGTTTTGAGATTTATCTTTGGGATATGATTTATTTGCTCATGGCATGTATATATTCGATCACTCTGATTTATATTCCGCTGTAACTGTTGAGAATTACATACATGTCTATCGGTTTTTGAATTTTGAATAAGACGTAATCTCTATTTCTTGAATAAATGTATTATTCGCATGTTTAATTGCTTTAATAGAAATAGGAGCGTTACATGTCCCGTTACACTCCTCTCTTAGTAGCTGGCTTTTAAATTGGTTAGAAAAGAAAGATAAATTAGGCTCACAGTTATTTTGCACTATTTTGTGGAAAATGTGGTTTTATAGGAATCAAATGGTGTTCAAAATGGTTAATACCTTTCCCCCTGATGTTGCTACTGCTGCACTTGATTTTGTTGTTGATTTTAATCAAACAGTACCTGCTAAGAAATCCAAGGGGCAGCAACCCATTGCTGCTGCTCCTAGTCCTGTTCAGAATGCTCATATTATCCAGGTTGATGCAGGTTGTTTTCCGGAGGGATACACCACTTATGGCTGCGTGTTTAAGGCTGCTCCAGATAACATTTTTTTCTCAGCGTGCAAGAAAGAGGAGCTGATAACAGATCCTGTCATGGCAGAAACTTTAGCCATTCGTTGGTGTCTCAATTTAGCTAAGGAAAGAGGCCTTCAGGACATCATTATCCAATCTGATGCTCTTGCTGTTGTTGAGTGTTTTAGAGGGTCAAATTCACTTGCTTGTATTGCTTTGATAATTCTAGATTGTAAGGTACTTATGAATGAATTCAATAGTGTGTCTATTAATTATGTTTCTAGAGATCTAAATGCATTAGCACATAGGCTTGTTGGCTATACTATGCAAGTTGGTTGTAAGTCATGGAATGGATATGCTTTTCGTGTTATTGCAATTCCTACTATCTGTAACACTTCTATTATCTAATGAAGATGTTTGAATTTAAAAAAAAAGGGATAGTTGTGAAGAGAAAGACATACACAATAAATTAATAATATAACATTAAGAACATGTTATATTGTAATTTAGGTAAATCTCACATGTGGCCAAAACATAAACATGAAAATTTATTGTTATATTTCAGAATTGAAAATATTCTCAGCATCAATTGGCAATCATAAGCTAATTTATTTTTTGGATGAAAGAATTCTTAATTAGATATTTGTCACAAGACCAAACTCCATATTACAATAACTCATTGTCCTAGAACCTGGAATGGTAACACCAAAAATAAAAAATTGCGGTCTTGAATTAATTCAATTTCTTTTTCAAATAATTGACTTGGTCCTTATTTCGAATAGCTACATACAGGCTCAAGGGTCAAAGAAGATTCTACCCGCCATTTTTTACATATTCCACACGTTTAGGTTGAATTGACAGAACCGTGGATCATGGGTTATTTTTTCTCAGCCCACACTTGCTTCCTAAGCAGCCCATTAAATTTCCAGTTATACCAAACTTTTTCAATCTTATTAGTTTCTCACGTCTTATTTAAATTGTAAAATTCAAAATATTTAATGTGTTTTTGAGAGTTTTATGGGGTGTTAATGCTGTTGGGATTTTATAATCCAAACTGCATATGACGCATGAGAAGTAAGGAGTCTAAATCCTATTTCTATCAATTTTGGTTGCTTCTTAGCTGCTTCTACAAATAAAATTCAGAGAAGATTCCCAAAGACAACAAAATTCCTACATTGTGAGAGTGTTTTTTTCTTCCGTTTTTCTAGATAGCTTTGCTTTTCTTTTTGACGACAGGAGTAATGTTTCCACTCTTGCCAACATTAACTTAAGACTTAAGTTGAATTGGCCTTATTCTATTTCTAGATGACTTTTTTGGACACAATCGTATTTATATATTTGAATCTTTCAAAAGGAAGGACGGTGAAACTTAAAGCTAGTTCACTTTATTGAGAACTTTCCTTTCATGGTTTTAGAGCCAAAATCTTCTCCATTTTTAAAAAGAAATGATGAGTTCAGATATTATAGTTTTGTGTGTATGGATCATATAAATGTTTTAATAAATCTCGCATGCTTTAGAAATGTGTGATATTTATGCAAAAATTAATGTGTCATATTATACACACAAAATTATATTTCCGTCATTTTAAAATAAATGTCATTTTAGAAATTCAATGATAAAATTAACTTATGAGTTTGAATGGAGATGATGAACTTATGAACCCCAATATAATTTTTTAATCCAGATTTTTTTTAATTTTAAAATTATATTATTTTAATATTATTTAAACCTATTTTTTAATTAAAAAAAATAATGATATGGATATTGGTTAATGACATGAAGTCAATTTAATCCAAGTAAAGTGTGCCACATCATTGCCACATCTTAAAAAATGGTGGGGATCGAAAAAATCTCAAAGATTGTATCATAAGAGGACCAAAAATCTGGTTTTAGAAATACGGGACTAAATGTCAAAGTTTTACAAAATAAGAAAACCAAAAATCATTTAAGCCTAAAAAAACACATCGTGGATAAGTTGCTAATAGCTACTCCCTCCGTCCCAAATTGTATGACGTTTTGGCCATTTCACACGTATTAAGAAATGTAATTAATATTGTGTGGGGAAGAGAAATTATGAGTTGTTTTACAAAATTATCCTTAATAAATTGTATGGAAAAGATAAATGAAATAATTGAAAGAAGATGGAGTAATTAATAGTTAAGGATATAATAGGAAAAATAACATTAATATTTTATTGGTATTGTAAAACAACATATAATTTGGGACAAATTTTTTTTCCAAAGGGACATACAATTTGGGACGGAGGGAGTACCAAATAAGCATACAGATTGAATTTATAGTGTTTATGAAAATTAGCATTTGAATTAATCGATCTGTATGAAATAACATAAATGTATATCTTTAATTAATATTTATTATTTTTCAATTACGATAATAAGTGTAAAATTGAGAGAGAAAAATGACAAGAACACTACTTGAAGTTGCGAATTATCAAAAATTGTTATAACCTCATAAATAAAATGATATAAGCTCTTGATAAAAATTGTTGCAATCACATCTATTTTGCTCATACAAGCATTTAAGTTATAAGCTTAAAAGTTAATCTTACCAAATAGAGCCCAGAATTATTTGAATATATGCACATCTAGTGTTTATAGTATGGTGGGGAAAATTGGCATAGAGAAAGTAAAGGAACACATTCACACCATACAAAAACAGAATCGAATTGAACTGTTGAATTGAACCGAACTAAATAAAAATAAAAAAACTGAATTATTACTGACAATTTTGAAATTGAACTGAAACAGTTCAATTCAGTTTAAAACAGTTCAGCTCGATTCAAAACAGTTTGGTTCGGTTCAATAACTAAAATTCGATTTTATTTTATTTTTATATTTTTTCAAAGATACCAATAATAACAGTTCAAAATACAAACAATTCGATTCAGTTCAATTATTTTAAATTTAACAAACAGTTCGATTCAGTTCAGTTTTCATCCCGAACCGAACCATGCACACCTCGGTCTAAGAGGGAGCTATAGTATAAAATTGGCTTATTAGATTGTTTGGTCCCTTATTTAATTTCATGTTTTCATTTTGGTCTCACATTTAATAAAAATGGCGTTTTGATCCCTCACCTTTTTCTCCGTTTGCCAAATAAATCTCAACCGTTAAGTTTAATAAAAATGATGTTTATGGTGGATCATCTTTAAGAGTGGTACACCATAGATCCTATTAATTATTTTAATTTCGACCGTTTGATTTTTTTTTAAAAAGAGAACCATTGAATTAAGCAGGTCTATTTTATCTTACGATGTACCACCAACACCTAATTTTTTTCTTTTCTTCATCTTCATCAATCATATTCATACAAACATACTCAGAAAAATAAATTAAAACAAGAAACCAGAAAAAAGAAAAATATCATCATCAACACTATAATCATCCTTTCTCTCTAAAAAAAACATGGATCTGTGGTGGTTCAAGGTCGCACGCGGTGGGAACAATGGGTTTAACGGCGGCGATGGGTTGAACGGCGACGACATGAACGGCGGTGATGGTTTTTTAGCCGCGGTGACACTTTTTCCCCTTCCTGCTTCATGAATCACATGCTTTTCATGTGGTTCTTGGATTACGTTTTTTTAGTTTGAGAACATATGGAGATGATGATGAGAATGGATAGATTTTGGTTTGATTTTGTGTTTGTTGATGTTGTACGAATTATTTGATATGAGAAGAGATTAATCTGAATTTGTTTGGATTTCTTGTTGTTTGTTGTTGAACCTGTGTTGATTGTTGTTGCTATTATTTGCCCAAATTTTCCTTTGTTGTTGCTCGTTGGAGAAGAACAGGAAAAGAAATTGGAATTTTTAATTTGGCATTATGGGTATTTTAGGTATTTCACTTATTTACCATTATTTTATGAAGATCATGAATAAGAAGGTGAAGATCTAATGGTCCATTTTATGATAAATAGATCGAATGGTTAAAATTAACAAAATTAATAAGGTCTAGAATAGACCACTTTTAAGGTTGATCCACCATAGATATTTAGAGTTAAAGTTAACACTTGGGATTTAATTGACAAACGGAGAAAAAGATGACGGACCAAAATGCCATTTTTAATAAATGTGGGACCAAAATGAAAATATGAAATTAAATAAGGGACCAAACGATCTAATAAGCCTATAAAATTAGTGACATGTTGATAAATAAATAAAGGCTTAAATGCTCTTTTGGTCCCTTAACTATTTAATTGGTATCGCTTTGGTCTCTTAACTAAAAAAAAGATTCTTTGAGGATTTTAAGTTTTTTTTTAGTCTCGTTTTGGTCCTTTCTGTTAGGTTTCCGTTAGGGTTTTAAAAAAAAGTTAACTTCTGGACACGTGTCACCTTGCCATTGGCTCTGAGTTTTTTTTTTTTTTTTAAATTATTATTCTTTTAAAATATATATATATTTTTTAAAAAAAATTCCAAAGTCAATGACAACGTGACACGTGTCCCAGAGTTAACACGTGTCACCTTGTCATTGGTTCTAGGAATTTTTTTACAAAAAAATAATATATATATATTTAAAAAAAATTAATTTTTTTTTATAAAAAAATAAATCTCAGAGCCAATGACAAGGTGACACGTGTCCACCTTTAACGTTTTTTTATTAAAACTAACGGAAACCTAACAGAAGGGACCAAAACGAGACTAAAAAAAAACTTAAAATCCTCAAACAATCTTTTTTTTAGTTAAGGAACCAAAGCGATACCAATTAAATAGTTAAGGGAGCAAAAGAGCATTTAAGCCATAAATAAATTAACGTGCATGACTAAATGCAAGAATAAATAAACATCTGTTGAATAGATATGTCTTTTTGAGAGATGAGATCATGAAAACAACATCACGTTGTCACTCGCATGATTCACGGCAGTAGCAGTTTATCTCTCTGTTTTTTAGTTTAGATTTTCGATAAATATATGTATAATATGTGTCTAAGTACATTTAAGTAAGATAATCACTTGATAAACAAGTTCATGTTAGATTAGAGAGAGTTGAAATTTGGACGTATATCATGAGTGACGGAAGCAGACGTGGAAGGGCAGCGTCACAACCTTGTCACAAACGTTAGAACCAATCGAAACGACGCGGAAAAAGCTTCGAAGATTCCATGTCTTTTCTCTTTGACTTTTTTTCTTCACGTTACTTTACTGCTTCTAATTCAAGATCTAAATCGTCCAATTTTTAATTTGTTTAGGCAATTATAGGAATAGGAAATAGTAACAATCATTTCATTTTGGGGAAGGGTCAATGAGAAACAAGGTTGGTTCCGCGGGTAGAAAGGGTCAACAATTAGACCTCTCTCCAATATACTACTCACTCACTCACCATTTCAATCCTATGACCAAAGACCAAAGAAAATTCATTCACTCGTCGAGCCACTTTTTTGAAGTCAAACTTTTCTTTCCTTTTTTGTTTCCTTTCTTTTCCCACTCTTTTCTTCCCTTCAAAACACACACCCCCTTTATATCCCATCCCCATAACTCACCTTCATTACCAAATCCCAACACCTATGTTTTAGTTTTAGCCATTTTTTCATTAATTTTTTTTTAAACTCTATTTTCAGAACTAATCATTCTCAATCTACATGGGAGATTCAAAGAACTTAATAGATGAGCTACTACATGGATTGGAGTTGGCAAGACAGCTTCAAATCTATCTCAACGTGTCTTCTTCGTCCAATGAAACACGTGAGATTTTGATCCAGAAAATTATATCCACGTTTGAAAAGGCACTTGAAATGGTTAACCGTAAAAGACATGTTAATATGGGTGAGTCTTCAAAGCAACAATACCCCTCAGCCTCAGGAACACTTGCCATCCGAATATCAGATTCACCACCTTTGAGCTGTAGTCCACGAAGTGAAGACTCCGACAGAGATTTTAACCGTGATCACAATGCTTCTAGAAAAAGGTATGTAAATTTGTTAGCTACTCTACTATTAATTAAACACATTAGATCGTATCCACGTAAGTTTAGCTCAGTTGGTAGAGACAAGGTTGATTTGCTTCTTTGTATGTATTCTACTAAACATGTGACCTTACCCTAGATATATATATATATTTATTTTAGGAACACTCTACCAATTAGATGGACAAAACATATTCGAGTTGAACCAGGAATGGCAATGGAAGGTCCTCTTGATGATGGGTATAGTTGGAGAAAATATGGTCAGAAAGACATCCTTGGAGCCATGCATCCAAGGTATATAATTTCTGAATTTAATGTTATATATCTATTGATATAGTTTTGTTACATAAATTTTGGATGTGTGTATGCAGAGGCTATTACAGATGCACTCATAGAAACGTTCTAGGATGTTTGGCAACAAAGCAAGTACAAAGATCTGATGAAGACCCAACAATCTTCGAAATCACATACCGAGGAAACCACACATGCACAATTGCTTCCAATGTGGTTGGTCCAACATTAAATAATCCATTCCAAACACAAGAAACAAATATTGTTAACACAAACCCTCAAAGCCTTGATCAACAAAAACCACCAAATGAACAACTTTTGAACAACCTACGAACAGGTCTAAGAGTTCAAACTGAGAACCTAGATTTCCAAAACCAATCATTTGTTCCATTTGGAAACCATGTACTTGAAAGTAGCTTTGCTGAAAACTTCAATTCTCCTTCATATGTTTCCCCTGCAAATTCAGGAATAAGTCACTTCTCGATGTCTCCAACTCCAAGTGTGTTCCCAAATATGGCAAGTGAGATTATTCCACCAGCTACTTCTGCTGCAAACACACCAACGGCTTCAATGGAGTTTCCATTTGATCAATTTGAATTTGATGGCCAAAACTTCACCTTCCACAACTCACGATTTTTCTCTTAAATACACTAAACTATGACAAGAAGCTAATGAATATTTTGATAATATTTTTTTTTTTTAGGAGATTTGATAATAATGTGTTAGAACTAGATGTTTTGTATCACTAAGACTCTGCAAAATCAAGAGGTTGAATACATTTGTCCTAGCTACTCATATAGTAGGGATATGGAAGTGCAATTTTACAATTGAATTATCATTGAAAATTAGAGTTATGAAAAGAAATTGGTTTCTAATTTTAATGCTTAGTGACATAATTAGAAACACATGCTATTTTCATTAATTTTCGATGATAATTCAATTTTTTTTAGCTTGACTTACTAGTGCTTCCATATGTGCAACAATGTAAAGTACGCGTTGAAATGGTCGTTTTATTCAAGTTGAAAAGAAGGGGGCAAAAAAAGACAATCCAATTGAATTAGTCTTCAATTCGATATCAAATAACTCAAATGTTTTTCCTGAGGGGAAAAAACAGAAATGTTATATATGCACACACAATTAAGTTGACAAAAATACAATACAGTGTCCCTTTGTGTTTTTTAATATTTTGATACTTCGTGTAAATTATATAAGACGAGAAAGTAAGTGAGAGTTAGAGATAAAACTATATGGTGTCACACATACGATGTCTAAAATTTTGTGTTTAAATAACATAGATTATCAAATGAATATTCTGACCGACTTCATGACCGACAAAGCAGCTTAAGAAATTGATTTTGTGGGTAAACTTAGTATCTTAGATGCACCGGTGTAAAGACTCATCCCTCAAACAGAGGTTGTCTATGATTCGAACCTTAAACTATAGAAATATAATAAATAATTTAAACTATTTTCATTCCTTCAATTTAATCTCAAAATTATAATTCTCTTTCCTATTTTTAAAAGAAATTGAGGAATTGGCAGGGATAATTTGTGTAGGGGCCGGGGTTCGACCCCCGAATTCCCCACTTCTCCACACATAATGTGTGTGAATCTAGCCACTAGGCTACTTGACTAAAAAAAATAAAATTGAGAAACTGGCTTAATAGACTAATTATAGTTTAAAGACAACTTATTATACTTTTATAATTTATGTGATCAAATAAGAGAGCGTGATAGTTTAAAAACTTATTATACTTTTATATCTGATCAAATAGGAGAATGTGATAGTTTAAAAACTAAATTGATCGTTTATGTCTTTTAAAATGAAAAAAAGAGGGTGATTGGATGTTCCAGGCCTTAAATGTAAAGATAGTGCCACTTGTAAGAATTTTCTACTTGGTACCCCGGGTCCTGCTATTCTTAATTTCTACCCACAAATCCAATAAATTGACAAAAATAATATTTTTGTTATTTTGTTCAAATTATTTGGAATAAAATAGAATGAAATAAAAAAATATCCAAAATTTTCACCTTTTAAAATTTCAGAACATAATTGTGTTATGAATATTTCATTTAAAAAAAAATGAACAAATTTATTTACAATCTTTCACATTTTCCTAAAGAAAAAAATTAGCTTCATGTTTTCAGCTAAATCTGGAGTTATATTTTGTTCCGGTCTTTATATATGTTTGTTCGTTGGTTTTCATTTCTAAACAATCGCACCAAATAACACTCATTTTTTTACACTTGAATGAGATGATAAAAGATCTTTTTAGTTCAACTAGAGGATACTCGATTAACAAAAAAAAAAAAACCTCTGCTAATTTTATTTTTTATGAGCCAACCTCTACTAAATTATCTTCTATAAATTTAAGCAAAAGCAAACCTAAAGGGAAAACATGTAATGTTCATTGCTCATCACATCACCCCTTCACATTCCAGCCTGTTCAATATAGTTTTATTTTCAACATTTGTTGAAAGGCCAAATGGAACAAGGCACCCAAACTTAACCAAAGTTTGTCGTTTTTTTTTTGTAGTGACTGAATTCAAACTCGAACCTTGCATATATTATGCATTGTCCTTACCAACTAAACTAAGCTCACGGAGACGTTTGCCATATCTTTTAACAACGGAGTTGAATTTTGGAAATAGAAACAGATGAAATTAAAGTGGTCAATTACAAGAGTGTCCCAGTATACTAGCTAGCTATAGCTTTATACTTGTGGTGACCAATTACAGTACACTATAACAATTACTATAGTTATAAAACAAAAAGAAAATGATGATGAGATGCTTGTAAATTAAATGACTCTATCACGTACTCTGTTACTTGTACAGCTACGTACATACAAAGTTACATTAAGCAATAACAAAGATAGAGATGTTTGGTAAGGAGAGTGTGGACTAGACATATGCATATGACCCATTTTTAGCAGAATGTTTGCTGGATTTGTTGAGCAAGTTCTTCAGCACTCAGTTGGCATTCAATTCCAATCTATATAAATCAATTAATACACCATAGTATTAATTAGAAACCACTCTTATATAATATATTAGTGGACCTAAATTGAACACATAAGTAGCATATAACATATACATATATGATATACCCAATCATAGGCTTGCTTTCATGAGATAATAACAAATACTATAAATAATATATACGTCTTTTTCATCAAATGAGGACAAATGTCTGAATGAAGTCACGATGCATGTTACATGTACCTTGGCACACCAGAGAGGTGCAGTGAAATATATACAGCCACTACTTTTAAAGTACATCAAACCATTTACTTTTTGACATATATAATTAATCACAGTAAAAAACTGCACTAGGTATTACTAGCATAAAGAAAAATCATTGTTACTATACTTGATTTTATTGTGATGGAATATTTTTGTTCCTATTGAAGAGTAAAATGAAAGGAAAAGACTACACATGCATAATAATATTCCAAGAATAAACGTACCTTGATAGTGAAGGAGTTCAACATGGTATCATCAGAAGTACTATTAATGTTAACATGGAGAATTTCAAGTGCAAGATCTTCAAGTGCAGATATAATCTTCAAAGGTTGTCCTGGAATTCTTTGAGAAACAGTTTTCAAAAGAACATGAGGACCTGAAAACTTGACCTCCACGTCAGCAATAGGAGACTTTGAATTAGCAACAAGTTCATTGATGTTATCATTGACTGAGGAAGTAGAGGAACTAGTAGGTGATGGATCAAGAGGTGAAAGTGCAATGTAGCTTTGTTGCATTCGTGGTTTGTAAGGGCTAGTTGGTTGTGGAGTTCTTGGACTAATTGGCAAGTTTAGTCTTGGACTTAGAGGTGGTTTTCTTGGACTTAGTGGTGAAGGTCTTGGACTTGGAACTAATCTTGGACTTAGTACTTCACTGTATACTTTTCTTTGTTTCTTGGCTTCAAGGGCTTGGAGTAGTTGTTGCAACTCTGTGATGTAATCAACTACACCTCCAATTATTGATGCTTGATCTCCCTAGTTAAATTAGTTGCATTAGATTGAGTGCATAAGGGAAATGGATTTGCTGCAATCAAATAATGACTACTTATCTAATTTTAATTAGTGAGTTATAATACTTTTTATTTATTTGACAATTTAACCATCTTCATCACATAACTACAAGATTCCTATGTAGAAAATCCGGGTCTATGCACAAAAAGTAATCAAATTTATAAGTAAAAAAAGCAAAATATTGATAGATCAGCTTTTTAAGTCACAATAGAATTGTTATTTTTTTCCTGTTTTTTTAAAAAGAGCCGCGTAAATGCAGACCCCACTGCAACAAATTATAATGCACGCTCCACATCTTAGATAAACCATAAGTTTGCACTCCATGTGAGTGTAGTAGAGGTCACTTGTCTAGGTTATGGACCTTCGTAATCACTTATTGACCCCATTTAAGTAAGTAATAGAGTTGTTAATTTAAGTACAATGGAAACATGGTGCATGCATGAATTCATTTTCTAATTTAAAAGGGTAATCTTAGAAAGAAAAAAAAAATTGATTTTAACATGTTTCATTAATTTTTTAAGTCCAAATGCTATATTATTATTAAAAGTATATTTTTATTTGAAACATATTGAGTTTTAACCTTAAATCTATTGTTCAACTTAATTTTACATGAATATATATCTTCGATCTATAATTATTATATATTTAAAATCAATTTTTGTAACCATAGAAACAAATATACACTTACCCTTTTGACATAAAAGCAAGGCATAAGTGACCTTAAAACAGACAAATGCTCATTCATTTGCTTTCTTCTGTTTCGCTCCACAGTAATATGAGAAACCCTTTGTTGTCCATCAACACTGTTAATCTGTTCCTCAAGCAAAGTTGGTGTCAGCTTCTGTCTCTTCCTTTTGGGTTCAGTTTCAAGTTCAGTTTCAGAATCTTGCAGCGAAGAGGTTGATTTTTGAGACACCAATCTCGATGTCGAAGTGACCTCATTCTCTTTTGGAGTAGCAGCTTCAGCTTGGTTGATAAGAGGAAAATCAGTAAAATCTTCTAGACTCTCCAAAATGGCGAAGAGATCATCGCTGTTACCGAATTCTGTTCTGTCTTCAAATATATCATATAAGCTTTCATCCATTGGAAAAGATTGAGAAATGGAAAAAGTGTGGAGACAAAAATGGTGTAAATATAGGAGAGGTGTTTTTCTAAACCGTTAGATGACAGGAAAGGAATCTCTGGAGAAGCAGCAGATCAGAGACAGAATGCAGAAATATTGCAGAGAGAGTGAGAGAGAAGATAGAGATAGAAGATAAAATGGGGAAAGAGAAGGGTTTTAGAAGTTTTTTATATAGTGATAGTAGTGCTAAAGGAGTAATGTTTATGGAGTAGTAATAATATATGTAGCTGCATATATACTTAATTTAGGGTAGTTAGTTATTTTGTCTCTTTATTATTACAAGTACTGCAAGTGGAGGTTATATAAATAAAAGGGTAATATACTACTATGCATGTCCAATGAGAGTTAAATATGCTGTTTGTAATTAGGCACTGAGGGAAGAAAAAACTGAGCATCCATCCACATTGAAATTGTCATTCATAAATACCACTGTTCTTCATCATTAATATGTCATTGAAATGTTTGGTTTTTTTATTTCTAGTGGGGGTGTGAACGGTAAAATATTTAAACTTGATTTGATGTACCTCGGATACTTGTAGTCTAGCACTGAAATACAAAAGCATTTAGTAGATAATAGTACTAAGATCACCTCAAAACAGTGTTGATCCTTAGAGAGTCTTTAAGTTCAATAAATGTAGCTTTGTTAGAGAAGATTGAGGCGACAGCACCATGCAAAATGATTGTTTGTTGAAGCAACTCCTCCATAAAAAACTGTAAAAAGTAAACATTTGTATTTAATATCTCTTTTTTGTGTATAAAAGTAAAAACAGTATCCTTCAAAAAAAGAGTAAAAACTAAAGGTAATTTAAAATTACATTTAATCAACATTTTAAGTTAAACAAAAAGTATTTGTCATAAATAGTTAAACATATAGCATTATTAGACGATGTTTACACAAAAATATAAGTATTCAAATCATGTATTGGCGATTAGACTGAAAAAGAGTTATCTGCATATCAGCTTCGTCACAATTAGTTGGCGTTGGAATAAGTTGATGGTGTGAATCGACTGACATCTGAATTGATTGACGGTTGAACGAGACTACCAAGTCTATATAGGTTAAAAAGAATGTTATAACCCTTATTGAAAATATTTGCATATTAGCTGCATTACAATCATCTAACTTTGAAATCATTTGATGCATAATTGAAACCAGTTGTTGATGGTTGAACGTGACTATCAAGTCTAAATGGACTTTGATGCTATTAGTAGGTCTTATAGGGTTGTGATTAAGTTTAATAAGAACCCAAGAGGTAATATAATCAGTTTCCTACATATGTGACATGATAAAAGAAGTGTTAAAGAGAGAAAAAAAAATATATATAAAATTTACTGCAAAGTCGCTTTGAATGACAAATAAGTGGTCAAATTAACATTAATCGTTTTCTTTAAAATAGGATTGTGAAGAACACGGTTAGAAGACAACCAAGCAGTTAGTCGTACAAGTACAACTCTGCCCTCAACTCAAAAGTATGGACAAGATATTAGCTAACTAAGTCCAGAATGCGCACGAAGACGTATTCCCATAATAATATGGTTATGCATGATATAGTTGGTTGATATGGAAGTAAATAACTTAGCATACATGGAAGTTTCATGTTGTAACTCATGCTACAGGGTAGTTACCTACATTAGTGGTGTTTGCCATGCATTCTTAGCGGTGAAGGTCTTTACATATCTTTTTTTCGTTTTTCTCTAATGCTTTCTTTTATTTTCCATGCATTCTTAGATAGTAATTCAACCTTGAACACTAAAACCAACGTCTCTAGGAACTTGCAACTGAGATACATAGTCTCTTTCATAGTGTAGTTGATCCCTTATTCGAAAAGGGGATCATAGTCTAAAGTGCAAGTTAGTCTGCATATCATATTATGAATTGAGCTAACGAAGAATCAAGTAACAAACGACTAATCAACTGATCACATGAGTAGTCGAGTAAGCATCAAATTTTGCATTAAGACAACATGCTTATAGCCAATTCTGAATTTTTTTTTTTTTTTGAATAAGCAAATTTTATTAGCTAGGATAAGCCAATTCTGATTAATAGTATCAGTTATGGGTATATTTGAAGAAAACAATAAGTATATTCAATAATTTGGTAATAGATATATATTAGAGACAAATCTTTTCTCAAAAGAGAATAAATTTAGGGACATATACAGTTAATAATTAATAAATACTTTAATTTAGCATATTGCTTTTGTCTATTTTTATAATCACTTCTTGTGCAAATGCGAAAAAGTGCTTATAAAAAGGGACATAGCGTGTAGGTATTTGTTTTGATTAATTGAACAACTGTGTTGTTTCTGTTGATCATAGTATGATTGTGTAATTAATTACTACACCCTCCGATCATTATTATAAGCAAAAATCAACATTTTAGATACATTTATTAAATGATGTATGTAATATTTATTATAAACCACATACATCATTTAATGAATGAATATAAAATGTTGATTTTTGATTATAATAGTGACCGGATGGTGTATATATTTGCTGCTTAATGCCTAGGTTCAAATTATATATTTATATTATATTTCACCCTGGCCCAATTATATGCATATATTTAATAATAGAAAGACATGTGGTTGTCCCCGTAAGCTTTGCTCAGTTGGTATAGACAAATGCATTTTATATGCAGGGGCCGGGGTTCGAACCCCGAACACCTCACTTTTCCATATTTAAAATGTGTGAGCTCCAGCCACTAGGCTACCTGAAAAAGAAAAAAAAAAAGACATGTAGTTAAGAAGAATGAAGCCTGTATGTATAAAGGAGCAGTGATGGTATGGAAACAATTTAAAAAGAAGCCTTGGTACCTAGGTCACTTTTTATTAATTTATGGAGGGGGAAATAAAACGGAACAAATGCATTCATAAATGTGGTTGTGAATGTGAAGTGGGAACACCGTTATTGCTACAAGACCAAAAATGGAGAATGTTCTGCATGAAAAATCTTACTATACATTTACCCAGCCTGTGACGGCACTGGTATAAATATTCGACTATGTCCTTTGCATATGTTTGCCGTGAGACCTAGACTTACCTTTGAAGAATTGCAAGTAATTTATACAACATCAATGAAAATTAATCCCATATAGTTCATAAACATTTAAGATACTTTGTTTACATAGTAATTTTTTACTCTAATTACAAATTGAATCCTTTTTTTAAGGATTACAAATTTAATCTTGTGTTTAGTTTTTATTGGGTGTTGCATAAACTACACTCTTTTTTAAAAGACTATGCAAAAAATTGATATTTGTACAACCAATCGAAGAAATCTCTCTCATACTATCACCATGTTACTCCACCCCCCATTTTTGGCCGAGAGAAGAGGAAAGATGAAGGTTGTCACAAAATAATCGTATAAATGTCATTACTAAAAAAATGACTCCATCTGTTTCAAAATATATGTCGCAATTTTACAATGTGCACTATTCATATAGCTTACTTTAACCATATTTTTTAACTAATATATAAATACAAATGTTAGCATATAAGATGTTTGATTTGTCTCGATGAATATTTTCAAAATATCAATTTTCTATAATTTTTATTATATATAATTAATTATAAAAATTATCAAAGTTTTGTATTGGCATGTGTGCACTGGTTGACTGCGACATGTATTTTGGAACGAATGGTGTATGTTCGTTTATTGGTTTTTGTGTGATTTCTAAGAAAAGCCTTTAAAATAATACAATCATTTTTCTTTTTTTGGGTCTTGCTAACAAACATCTCATAGATATTAGTTAAGATATCCACAAATAATAATTTTGTCTTGAAAATATAAGTAAATACTTTTAATCAAGATACACAAAAAATTTCTTTTTAAAAACTTACTACTTATTTTGATTGATTAGTCAATGCCTCTCGGACATTGTCCTTCTTTTTCAGACATTAAAATTCACACTTCACACCCTTTTTTCCTTTAGCCTAAACCACCAAAATTATCACCGTTCCTTTGTGCTGCACTCTCAAGCTAGTATGTAAAAATGTAAATTTAAATTAGTCTCAAACGCCGTAAAACATAACGTTTGTGACTAATCACAATGTTACTTGATGATGTGTTCAAAGTGAATTATTAAAAGTCTTCATCACTGATTAATCTTTAAGATCACAAAAATTTCACAATTAAAGACTCCTTAAAATTGTAAAATGTTAATCAAATTAGTCCTATAAATATTTGTGCTTATGCATGTCATAAAAAATGCTAGCAAAATAGTTAAACGTTCAACTAAGTTTGATGTGTACCTATGGACAGATATTTCATACGGCTTTGTGTAGCTACAACTACACCGATTTTATTTTATTTTACATATGAAAGATATCTATAAGAATAAGATGTTAAAGTTGGTGGTTCATTTTGCCTCAATTGGTGATTGTTAGAGTTACAAACAAACCTGAACTAATAAAACTAATAAAATTGTTATATTCAGTTAAATAGTATATCTCTACCTAAAATTATTATTTTAGCCACCAAAAACTAATAGACTAAAATGAAAGTCCCCACCTCAATAGTTAGGAAGCAGATTTCAATAGTTTTTTTTTTTTTTTGAGCAAAAGATTTCAATAGTTAAATCCCTAATTTTGTTTAAAATTCCTCATTTTCTTCCAATTCTCCCCGCGGATTTGGATCCTCACTAGAGTTAGTTATAAAAGCAATAGCTGATGTCACTCAAAAGTATATGCAGCAGTTGTATACAAGAGTAAAGTAGATTTTACTATATAAGCCTGTCTTTTTTCAAGAGTATATATATATATATATATCACTGTCTTTATGATAGATTATTTGCAAGGAGTGAGATGATAAACTAGTTGAAATACAAAAATGGAGAAATAGGAATAACATTGAAGCAAGGGAGGAGGACCTTCGTGGAAGACGAGGGGAGAGTGTGTGGGAGAGAGGGAAGAATAAGAGGAATAATAAAACTTTTAAAGAAAATAGAGATTCTAGTATAGTATAAGATGGATGAAAAATAACATAAGCACTAAGTTGAGTAAAAACTTTAAAGTTAAGAGTTTTTTTTGTTTTCCGTAATCTCAATGACTAATTCAAACGGTCTTATAGAGGGGAATAGATCGTCTCCTCTAAAAATATTTGTTATTTTCACCGATGTCAAATCTAAATCATTAAACATTTTCTCTCTCATGATTTTAACATTTAACTTCTTAAATAAATTTATTTTTCAATGGGTAGGATTTCCCTAGACCCTCCAGTCACATAGAGGATCTAGTCCCTCTTATAGAGTTATGATCTAATTTGGTGACTAGAACTTTCAATGTTTTCAATAGGTCAAATGCATCTAAAAGTCCTTTAAGTTTTTTATTTCTTCCAAAGTGGTCCTTTAAGTTTCAAAGGTCCCAAATAAGTCCTTTTAGTTTTTGAATTGTTTCAAACAAGTCTTATTGTAGATAGCATAGTTGGTAATTGTTTCCTTGAACTCATCTTTGGTACCAAATCTGGCTCCTAACACTCACTTAAAATTAGTCATCTTTTTAGGCATGGCAAATGGTGGATAATGCTCTTTGTTGTTATCATGTAAATCATCATCATCATCCTTGAAAATGACTTGTTTGAAACGATTCAAAAACTAAAAGGACTTGTTTGGGACTTTTGAAACTTAAAACGACTTTGAGAAAAACGAAAAACTTAAAGGACCTTTAGATGCATTTGACATTTTCAATAATAACAATAATAAATTGATATTTTTCTCTTCTTACTTATTTCTATTTGTATGTGTGCTTAAACCAATTATTTCTGTGGTTGTGACCATACAAGAATCGCTCTCTTTTTTAAAAAGAAATTGGAGTCCTCTTATAAAAAAAAAAAAAAAATTGAAGAATTAGAAAATATTTTTAATAGTGGTTGTACTAACGACCTATAGGGACGTGTTAGTGACTGATACTTTGTTTTGGAGTTCCAATGAGAAGCTTATAGGCAATGATATAAACTCAAAAATCAAACATGACGCTATCACTTAAATACATTAATAATTTAACAAAATGAAACTGATATCTTAGAGTCTAAAGTGTAATGTTGATGTGTCGGATATCATACACGTCTTTAATTCCAGTGTCGGTGCTACATAGCTTATGAATGATTTTTCTTTAAATTGTTAATTCAGCCTCCCTTTGGAAAAATGAAATATATAGTGAACTATGGATGTTATTAGTTATAAACTGCATCATGCAGCCATGGAATGGGAAGGGTGTTCTCTATGTCGGGGAGATGTTTGGTGCATTTATGAAGGTATTTGGTTTTTTATCGCATCTTCTTGTAAAAAATATCCGTTAGTTAGTTAGTTAGTTCTGAAGAGAAGAAATTAAAGACATGGAAAGACATGATCAAATGTTTTGAGATGAATTTTATGAGACTGGTATTTATTTATTCTGCCACTGGTAGTTATCAGCACAGATTTGGTACTTTATTTTCAGCTGGCTGGATGTGATATTGTGATGATTGATGTCCCACAAAAATTATGAGTATATTTTCAAATTTTGATGAGTTTAAAGATGAATCGATACAGGGGGGATTTGTAATGTAGTGATCCTCTGATGTTTTGCATAGCATGAAATATACATTATTCAACTGGTTTTATATATGCACACACAAAAAGCTACGGTTGCAATTTCTTTAAAATATACCGTCTTGTCTTTTTGTTGAGTAAATGTAATTTGTACGTCTTCGCCATATTGACATGTTTTACTGAGTAATAGACCGTCCATTATTTCATCAAAAGATAGAGAACAGAGCAAATTTACAGTGTAGGTACATATATACAAGAAAAGGAATACAACCACGTTGCAAGTACCAATTATATCCAAGCAAGATATCCATGTAATGTACTGATTAGAAACCACGTTGTGAACAGAGGTTGGGGAGCATCTATTCTGTATATTTTTACATCACGATCAGAAATATGAGAGGACCAGCAAAACGAGTCTGCCTTAGAGTTTATAGTGATATATTTGGTCTAACAATAACAAGTTTGTTTGTGTTCCTGTATCATTTCTGAGTAAGAGTTTCACATTGGATACAAAAGTGGATGTTGAGCATTTTAACTTATGTGTTAGGTTTTGGATAAAGTTGTTGTGTTCAACTCACTTGTGTGATTACTCTTGATCCAATGTGAATGATTCTCACACTCCCCCCCCTCGTGACGCAAATGATTAATTGAAATCTAATTCAAATTCTAATATGGTGTAATGCTTAAACGAGTTGGCAGCATAACATCCCTTAGATTTTACATTTATTTGATGAACTGCTTAATAAATAAAAAAAATTAAAAAGGAGCAACTTTGATTGGTTGAATTGTGTTTCGTGACTGATCACTTCGAGAAGCTTTTCCTCGAGATATATAGCAGTGCTGGAAAAGGGGGGCCAAATTGTAGCCTATGCGAAACAAATTTAAGTCCCCACTCTTAATTTGGGTGTTGTAGTGCTCAACTTTCAAAAGGAGTTTTCTATATTTTTCTCAATTTGTACATTTGTGATTTAGGTGTAACTACAACAAACTTATATTCGGTGGCATTTTTCTCACTTGCGACTGTATTTTTCTCTAATTCATGGCTACCATTTACCATCTCAAACTTAAGGATCGTGTTTTTAATTTGACGGGAGACAACAGCCTTGTAATGTTGTTCCATCTTGACGATGGCGTGACCGATTTAAAAGTATAATATAGTGAAGGAATAATAAATTTTGAAATGCATAATACACATGCACACACAAAAGATCTTTGAAATTATAAGATATATTCAAAATTAATAGATATCCAAAATCATAAGAAATTTTAATGATATAAGAAAGGCAAGTATCTTGAAGTTTGTCAGAGAATGACGAGACTAACATGATCTTTAAATAGAACAGAAATAAAATATGAAACAACAAAAATGCAGACATGTGAGGATGCAATCGCAACCAAGAAATCATTTGTAGTGGTCGAGAGTATTTGTTTTTTTTTTTAGGAAAAATAAAAATATATTAAAAAGAAAGAAATGCAAAGAATGGGGGACATTAGACCTGACCTAAGAAATCGTTTGTAATGGCCGAGAGTGTGAAAACAAAATCGCATGCAATTATTAGATATTTCTAAGCGAAATCACAATGAAGAATCATAATTTGAAATTCTAGTTAAAGATTAAGATTCTTATATAGCCTAGAAACTTATATATAGTTGTTTAAGGTTCAATATATTGAATGAAAAAAATAAACATTGAGATTGAAAAATATAACAGTATACTACTGCCACTGCAATATTAATTGAACTCAATGTCATAGGAGCAGGGTCGAGTTTAACTAATTATTTTATTAAGAAATATGAGCATTACTTAAAAAGAAGAATAATATGTGACCGTGGGAGTATTTGATTGGCTTATTTGAGTTATCTTTAGGTGCATCCAATGTATTTTAGGAAAATGTCACAAACAAATAAATAAATGATGAAGGTGTACAACACAGGAAAATGTTAGCATATGGAAGTGATGAGGAATGGTAGTGAGACAAATATCTGCAACTTGTGTCGTTCCTTACAGAGCTTTCAATGTGCAGACACGGCATCTCCGTGTCTACGATGATCACTCTCTCTCTTCTTTGAGGGGTCACTAGTTGCAGAATGACTCTGCTACCACCCATTCACAAATATGCAGGAGTTATTGCTACCCTTCTTCTGCATGGGTGTGCGTTTCATTAAAATTCATATATACACCCTCACTTTACAACTTCTTCAATTTTTCTCATTTATGTTTCTTCGAATACGTCCATTTTTTCCCTACCATACATAAATTTTCACATTTACCACCCTCAACAACCAACCAACCCTCACTGTCTCTAAATTTCACATGATGCCAAAACAAACAACTCTGAATTTAATTACTATATTAGGCCCAAAATGTTTCGTGCTGTCACTGTTTTTAGTTTAATATTTGGTAGTATATATTGAATAGTGTGATGAGTTTAACAGCACATTCATCTTATTGTAGGACATGCTATTTAAAAACTTCGGCGGGTTCTTAGGTTGTTTCAAATCGGCTACTTTTTAAACTTTTTTCGTATATTCTCATAACATGCATATGAAATCAAGTGGTGTGGACAATTCATATATATTTTTATCTGCCTTTAATTGTTTTGTAATACTACATTTATTATTCCATTCATCTCATATTATGTGTGTTAGAATAACAACCATCCGATTCAAAAGAGTAAAGAAACAATCAACAGAAACAATGTATAGACAACGTTAATGAAGTTCAACCAATTGTGTATACATCTCCAAATGAAGAGCGGTTGCAGATCATTTATATTATTCAGCTCAGTTTGGTAAAAATAGCGGATGACTAATAAGCTAGCTGATAGCTTATGGTTTATAGCTGATGGCGGATAGCTGATAAGCTACTTGAAGTGTTTGATAAAATTAGTGGTTCAATTAGCTGATAGATGTAAAATTACATAAAAGGACATTTTTAATTCATAATAAAGTTTATATCAATTAATATTTAAAGTATTTAAAAATTAAAAATTATTAATTTAATATTATTATTAAATTAATTTTTAATTCCTAAATGTTAATTTATATTTATTTTCATTTGCCTAAAAAAATTAGATATAAAGTGTTAAAAAAATTAAACGTAACAATAAATATAGTTTGGAGAAAATTTAAACGTAACGTTCTCATTTTTTTTTTTTTGGAGAAAATTATTGTCATTGTTCTTATTCTCTACAATTCTGATATATCATACAAAAATAACGTGTCATTTTGCAAAAAAAAAAATGTGACATTAAATATTGAAATAGTCCCAAAAAAAAACGTAACAATTGTAACGAAAAAAAACTTAAACGTAACGGTAAAAAAAAAATCTTTTTTTATTGAGAAAAAAAAGGACCTTTCATTCATAAAAAAAAAATAGCATTCATATTTAAAACATATGTATTTTAATTTATAATATAATAAATGATTAAGGGTAAAAAAAATGGAATTTAGTTAGAATAATAAGGGTAAAACTGGAATTAAAAGTGAGAAGCTATAAGCTCAAACGCTACTTGGAATAGCTTCTGAAAAATAGCTTATAAGCTCGTGAAATAAGCTATAAGCTCATGGTGAAAAAGTGTTACCAAATAGAACTTTTTTTGTCAAACGAGTTTATAAGCTATAAGCTCTTTTTTGGGTGTTACCAAACAGACCTTTAGTGAACAGATTATGGTTTATATTTACTTATAAGGAAACACCGGTAAGTGTCTTACGGACATATGTTAAGGTACCCAAAATAAAAATTAAGGTACCCAAAATTGTTTCAATAAATAATTATTCTTTGAGGAAACCTTAACTTGTACCATTATAATACATGTTAATCTGACCTTTATATAACTTCCTTTCTTAGTATCCTTAACCGATACCCCGAAGACACCTGTTAGCATTTCCCATATTTAAATACTAAAGCTCATATTACAACATAACTCATAAATAGTTTAAACATCAAATTATTGATCAAATGGATCATAGAGATGGTAAAATATAACTTCGTTTTTACCACTTCAAGTGTGACGAGTGATGTAATGCTCTCACAAACATCATCAAAATGATTGAGGTCTTTCTTAAAAAAAATGATTGAGGTCTGTAACCAACATCCCATCATTTAATATTGTCATATCATTTTTGTATATTTAATTATTTTATAATGAATTTAAATTTTGAATTAATTATGTCCACATGAAAGAATTTTGTGAAGCATTTTGTCAAAGTTTTTTTTTAAAGAATCAAAGTTATTATTAGGTAATTTCAAATACCACGTAAAAACAAAGAATTCAAAATTCTTTCATTACTCAATACAATGTTAATTTCAAATTGATCCTTATTATTTTAAAATTTTCATGTTTGTCACTATAAACTTTCAGAAACTGCAAATTGGTCGCTATAATTTTCCAAATTTCATAAATTATTCTCTAAATTTTTAAATTGGCCTTTTTCAAGTTTTGAAATTTTACAAAAATAATTCAACATAGTTAAGAATGAAGGATTTTTTTTTACTCTATACAAACAACAACAAAAGAGAAATAGAGGGAATTGAATGAAGCATTCAAATTGCCTAGAATTCTAAAGTTCTAATTATCCCATCCAGGCACAATCTTATGGCCTTTGCTTTAGGTTTTCTAACTTTTATTTATTTAAGTTCATGATCCAAAATAAAATAAAATCATCCAAAGTTGAAGTTGTGACAATTGGAGTTAAAATGATGCATCCAAACACTATGCTATAATTTACTTTCAACCAATACATATATTGGGACAATATCACTTCTATGCTTCAATACTAGCCCATTTAATTCGCTAATTTTTTATCCTATATCCCTTTTTTTTTTATTTAGTTGACATAGACTCAAGTAATTTCCTAAAATTAAGATGGTGTGTCAAGAATGATCGGGATAGCTCAGCTGGTACAGTAGAGGATTGAAAATCCTCGTGTCACCAGTTCAAATCTGATTCCCGGCGTAAAGACCTCCTCCTAGAAGCTCAAAAACAACAAAGGGGTATAATTACTAGAAGTAAACCTAAGAGACTCCAAATGAATATGGAAGAAAAAAATTGCTACTAATGGAATTTAATCATTGAAAAAATCTTTTTTTTTAAACCTTCCTCTTAGATTTGCATCACTAGCACCAATCAAGTTGAACTAAAGGGGAGAGTACAGGAAAAGTATAGCCTCGTGTCATACAAACAATATCAAAAAAACATATGTATAAGCATGAATGGGCAGGCCAATTATTTTACATTCAATTCACTTTAACCTAAATCAGGTCATTAAAACTCAAATACACTAAATCACATATGCATTAGATTGCATAAGAACTATATATGATTGACTGTAGGAGAAAGATAGCTTGTAAATCAAGTTTTAGGGTATTAGTAAGCTCCTTTAGAGATTATGCACAAAGTCAGGGTCAGGCTCCTATGCTAATTACATGATGTATCAGGTAGATACTTTTGGTAAGCCACATTGGCATAATTCATGATACATATATTTTGTTTCATGAATCATTCCATGGTTAGAGATGTTTGATAGGCTTACGCGGATCTAGATAAGCTACACTGAGCATCTTTGTATTTTCTACTTAAATTCAAGCATATAACTGTCTCGATCATTTATGGACCTGTCACACAACATAAATGGGAATGTGGGACAAAATTTAAAAACAAAATGTTACTACAATATAAAATTAAAATGAAAATGAAATTAATAAGATGGGTCCTAGCTCCTTAACAAAACTTCGTTCATTTTCCAATCTGAAAACACATTTATTAGCAACCACGAAATGTATGAGCAAAACATTACTGCTTTTTCACCTAATAAATAATAAAATCTCCCTTCTTTTCTCTTTCTTTCTCACACCCCCCTTTTGTATGTTCTTACTCTGGTGAGGGTTTCTTGGTAATTGTGTGGCATTCACAACGGGATGGATGTTGGAGGTAAATGTGAGTCCCACATGTTTGATTCTGTGCTTGATTTCTATGCCCCATTCTAGATGTCATGGCCCCATTTTGTTGCCTTTTGACCTTTGTGGCCTAAATACGGTGCAAACCTCATTTCCATGGATATTAACTTCGCTGCATGTGTTTGTCAGAAAATGTTAACGTAATTTAGAAACCTTTTCATGAGAGTGAGAGACATGCAATATGATCAATGTATGCAAAATTGCACTACTTAGCTCCCATTATTTAGTTAGCACTTTCGATTCTCGAGTTAATTTCATCACTCCTAAATAAGTAGAATTATCAACAAAAAGTTATACTTATTTTGCATAGAGTGATTGATTTTGCTATTGAAAACGTTTAGGGGCACACAACTTATTATCTGCTTGCATTCCATTCATGTGTACTCCAATTTTCATATATAGGTACAACAAAAATTACTTACAAAATTGAGCTAGGTGGATCTAGATCGAAGCAGTGGGTGTGGTAGCACTACGACGATCAAGTTAGTTTAATATTCAATGAGTGATGTTTTTGTTTAGAGTGATTGTGTACTTTTCTCGTATGCAAGTGTCTTTATATAGGATGAGCTTCGGAAATTCGTGGTAAAATTTGTTGAGTCGGTTAAGTGAAATACAATGTGATCTCCAAATCATCGTGTGATCTTAATTAATCATGTGGTGATGATTGAATCATGATTTACTATGAAGTGTCGTTAATGCGGTTCTTTAATTAATATGAAATTTCTAATTTTAGCGTCTTGGATTGAAATTAGAGGTTTCATGTTTTTCTTTCTCTAATTTTTTACCTAAATCAATTTTTATCCTAGGATTGGGTTTCTAAATTTCTTCAAAAAGTTTATGAGCTCATAGTTAGGTTTAAGAACAATTTATTTCTATAAGTTGCATAAAATTAGAGACAGTACTGACACTATCAATTAGTATAGCAGATTGTACAATCTCACATATGCATGAATAAGAATTAATAGAGGATTATCTTTGGTTCTCACTTCTCCTTACTCCCTTAAAAAAGAAGGACCTTAGTCCTTGCTGAAAGATATTGTACACAAGACAAAAAATTATAATCATTACTAGTATTTTTCTAGAAGCAGCAAGATTAAGCTGTTGTACATTATGGCTGAACCATCGGTGGCAGTTAGAAAATATGCAGTCAGAACTCAGAAGAATTCACAGTAAAAACCAGAGAAAATTATATGGATCAGTTTCTTGTTTTTATCTTGCCAATGAAATTCTGAAAATCTTTCGTCAGTTTCGTTCTTCTTGTAGAAAAAGATGCCTGCCATTTTGACATGCCGCCATACCAATAAATAGATGAGTTTTTCAAAATTGTCTTGCAAAAGTTTAAACAAATGTTGATGAATGTTCTAAAGGATTTTTAAGAGTTTAAAATAGTAAGATTTTATGAATATATATATATATATATATATATATATATATATATATATATATATATATTGGAAAATGTTAACTTGTCCCTCAAGGCACAAGTTTTCTTTTTTGTCTAGTAGCTACAGCTCACATAATTTAATTGTGGAGAATGTGGGGTGTTCGGGATTCAAACAACGGCCCCTACATATAATATGTAATATCCCTACTAATTGGCTATATTGGAAAATGTTAACTTATGCCCTCAAGGCACAAGTTAAGAAACCAAAGATAAAAACATTTTGTTGGAAATTGTGCATTTAATATTTTAGAAATTTGAAATCTTATCTTTTCAGGACATAATTTATGATTTAATTCTATTTTTAGATTTTTAACTTGTGCCCTTACGGCACAAATTAACACTACCCATATATATTTAATGTCTTGAAAATTAAAATGTTTACGTAAATGTATTCAAATAACTTTTTTTATTTGAAATCTTTAAAGGGTGTCAAGTGATCATTTTCCTATTTTTTTTATGAGGTATAAATATTTAAAAACATAATAATTGATTAAAATATGGATCAACCTAATACTATTTTAATTAAAAATAAAATAGATATAATTAGATACAAAAGTATAACACAATATTTTATTTTGGATTGTATTCTACAACTACAATACTTTTGTTCCTTTTGATTTGTTTCATTATAGTTTTCTTGAAGTTTATTTTTCCATAATGTTTTAATAGAATAATATTTTTATTTTTTTCCTTTAAAAAAAAAATAGAATAATATTTTTTCCTCATTTACATTATGAAATGTATTAATTGTTTTTTAATTAATGGTGTATGATAGATATCATTCAATTTTGAATTACAAATCACAGATACTAAATCACTAAACAACACCTTTAAAAAACTCACTAAACAACATACCTAAATTCATTAAACTATAGAACATTGCCTAATTCATAAAACTATATCACTAATCATCATCCTCATTTAGAACAGATGACCACCGTGGAGCAATACGCCTCGCGATCACCTTGATTTCCCTATCCTCCTCATGCGCTTCTAATAGTGGCATATGATGTACAGAGACACCACAATCGTAAGCAAGATCAATAACCCAAGGATCACTGAAATTACCACAGATATAGTGTAACACCCCGTTTTTCACTAGGATTATTTATTTATTTATTTATTATATGTGTTTAATTGTTTGTTTTTGTGTTTGATTTGGGATTAGTGGATTTTTAGACGAGAAGGGTATTTTAGTCATTTTTAAACTAAGGGCATTTGGTCATTTAATGAGTGAGGGTATTTTGGTAATCTTTGAATTGGAGGATATTTAGTATTTTAGTGTGATGAATTATTTTAGTAGGGTTAGTTGTAACTTGGGAAACCCCGACAGGGAAAAACAACCGAGAAATCATGAGTAATAATATCTCTCAAAGTTTAAACCTTCTATATTTTTTAATAGTAAAATATTTGAATCAATTATCATTAATTATTACCTCTATAATTAAAGGCAACATATTCATAATACAAGACATTTCCATCAAGAATAATGTTTGACCTATAGGCTTCCAAGTCGTCGCACTAAGATCTGGTTTTGATGCTTTGTATTCTTACCAGTGTGATATTTTTTTTATAAAGGCATCTTATATGTTTCCCTGTACCAATTCTATAAATAATTCAAAATAAGCGGCATTGTACATTAGACTTTATCTTTACATATGATATTACTATGTACCGAAATTGAACAATAATGGTCAAGAAAAGGTCACCAACACAAAGTAACATTATAACTCAAGGACGAAACTACCAAGGTCATCCATCTGATTTCTAAATTAAATTTGGAAACATTTGCAGATTTTCACCTTTTACTTTACATAAAATCAACCTAGACGTAATTTAAAAGGCCATGAAAACCATTTTCAACGACATTTTTCATGCAATCTTACATAAGAAGTGTAATGTCTCTAAAAGGATGGTTGGAATTGAATGTATACAATATTTAGACACATTATTACTATGGTAAGGAAGAGACAAATGTATTTGAGTTGAAATTTTGAATGATTTTTTCACATACAGAGAGAGAGATTTGTTATAGTGTTAAAAATGAATAAAATTCTACAATACTTTTTTAAATATAAAGACAAGTAATAAACAATTTTAATTTGTAGATGTTAATGAATCTTTAATTTCTCTAATATATAATAGTAGTGTTTATAATCTCAAGTATTTTTCTCAAAAATAATGACGTTATTATTTTATCACTTACACATTGCTAAAATTTTGTATAAATATTTATTATATATAATCTCGCCCCCACAAGTCAAAATTTTGGATATGTCATTTTATATATATATATATATATATATATATATATATATATATATATGTATATATATATATATATATATATATGTGTGTGTGTGTGTGTGTTTGTGTTAAATCTTATAATAGAAGTATGCGTGCAAGTAGACGTGCGTGTACGACTTATAAAAAAATAAGGTAGAAAGTTCATACTTTGCAAAGGGTAAACAAAATCTCAGGACATCCTAAATTCAATAATGTAGCAAGCAAGATGGATCCATAATAACCACCAACAAAAATTAAGATGTGTTAAATATTTTATATGAGTCATTATAGTTTTATTGAATTTCATAATTATGACATTAGTTTTATTGAATTTCACAAAATAACCAATAATATTGGTGTAACAACTATCTCCAATAACTCGAGTCATGACAAAAATAATTTGAACACATTAACACAACAACATTTAGTAAGAACACACAACTCCTATGTATTCTTTTTCTTATTTTCACACAACTCCGATACTCAAAATATTAGTAACAAGGTCCATGACAACAAATTGATTATGGTTGGTTCAATATATTAAAGAATATTGAAGACAAATCTATGTCTAGACATTCATGTTTTTGTATGAGATACAGATATTTAAAAACATAGAATTGATTAAAATATGGGTCAACCTGATTCTATTTTTTAAAATAAATAAAATAGATACTATTAGATACAAATGTATAACATTACATTTTATTTTGGATTGTATTCTAGAAATAAAATTATTTTGTTAATAGAATAATATTTTTTCTCGTTTACATTATAAAATGTATAATAATTGTTTTTTTAATAAATAGTGTATGATACGATATCATTCAATTTACAATTTTCCACAATTATTCATTGTAAAATTAATAAAGCGTGATTGAAATATTATATAATCATTTAAAATATTAACCTAACCCAAAATACTGGTGAAGTTTAACCTGGGAATGAAAACTTGGTTCCCACCATGGGAAAGTTTCAATTCCCAGGACAGGTGGCAGTTGACAACCTGCTATGGAGAGAGAGAAAAAAAATCTGAAAATAGATTTCTAATGTTTTTTGTTTCTTCCCGTGCACCCCCCATTTACTTCAGTATTGTCTCATGACTCTCATCTCATTTCTTTCTTTCCAGAACTGATTTCTTTTCAACTTACCCAGAAAAAATATACCAACAAGCATCTTCTTCAACATCTCATCTTCTTCAAACTCAACATCTTGTTTCACATTTTTCACCTAAAATCCACATGTTTTTTTTTACTGAATTTTAGAGTTGTATCTAAGTGTGCTACAGATCTACATATTTTACCTTTTCTGAAAGAACAATCCACCGATAATGGGTTTTCTTATTCCAAATTAGACCTATAAACTGCAGATCTGAAATAAAAACTCTTAATTTGATCGATGTCCATGAATTTCATTGCAAGCTGATAGTTTCACATATCTATTCTCAATGAAATTCGGGTTTAGTTGTGCTAACAATCAATAGAAGATTATAACAAATTTATATCTATCATTTTTCAATTATTTTAGAATAATGGACGATAAAAAAAATTGAAAATGATGGGCACATTCGGCTACAATGTAGGTCATGAACGTTGCAATGCTTACGGCAACCGCTATCCATGAATGTTGCTCAAATTTTATGTTATATATTTAAATACGTACATAATTTCAAAAAAAAAAAATACTAATTGCTTTAATATTGTGTATATTATTTAATATAAACAATGTAATTTAGGCCACCCATAATGAATGTAAAAAAAAAAAATTAAAGAAAAAAATTATTTTATGTCACATACAATAGTACACATGATTTAATTAATTTACTGCCACACGTTATTGATATTTTTAATCAAATTTTGAAAATTTATTACATCCTTCTCTAATTCAATTTAATATGACAGCATTCTATGAGATCAATTTAGTTCGAATTTTTTTATTGAAATCAATAAGCCCAAACCAAACTGATAAGGCACATGAATTCATACAAAAAATAAATTAAAACAAACAAATGCTAAATTATTATTTAATTAATTGGTGGGATAGGAATTTTTGTTACACAATGTCCAACAAGTTGCAACAATTACCACTTCTTCAATCTCAGCCATTCAATTAAAATACTATTAAATCTATGGTTGTAAAGGACACTTTCCCATCATGGAAAAAAGAATCATTTCCCATACTAAACGTTACCCAAAATACTCCCCTCTAAAATTCTTAAAAAACCCACATTTATTTAAATAACAAACACGAGATTTCTCTAGTCACCTTAGATACATTCTCGTTTACGTTTCCTCTCACCTCTTTCCTAACAACAACATGAAATAATTTTAGTCACCACTTTTGAAATCCACCGTAAACTTTCGACGATCTTCTCTTTCATAATCCACGATAACATATTCCAAATCAAGATTCAATAGGCCAATCATTCTTTCCTTTTCCATTAAATGCGGTACTTTGACTGTAACTTATTTTAATTTGTTCAACCCTTTTCTATATTTGAAGTTGTTTTGAACTTGTATGCATAAATGTTTATGTTAATTGTTCTTTATGATAATGTGTTCACATTTTCATTTATTTTTAAATTGGTTGTTTTTATGCATATAACGTGTTTGTAGAAATGCAAGCTTGTTTTTTACCATATGAATTACAAGTTTTAAGTCTTGTATGTGAGCAAATTATAGAATGTTATCACTGTATTTTGTGTTCAATGTTATACGGATGCATACAACGTGTTTGTAGAAATGCAATCTTGATTTTTAACGTACGAATTATAAGTTTTATGTCATATATGTGAGCAGAAAATCACTATATTTTGTGTCCAAAGTTGGCTAAAGAAAACCTGTCATTGGGGGGTGTTCGTAGGTGGGCTTGGGAAACCCAAAACCAAATCAAATAGGGTACTTCGATTTGGGTGAGGTAAAATAACCACTTGTCATACTATTGGGTGGGTTTGGGCAATCCCACTAATTTTTGGGTTGGGTTGGATTGGGTAATGGGTTATCCAAGTTATTTTTCTATTTTTTTAATATTAAATGATTAAATGACATGTCCTCATAATTTTGTTTTAAAATAGTATTCTACTTTTTAATTTTCTTAAAAAGAATGTTTAACTTATTTTACTATAATTTTATGCATCATAGAATATCAAATAATAAACTCCATCATAAAATACTTGCAACAAACTAAAGTTGCATGACATAAAATTGCAATAGTATTAAAATAAACAAAAAGTGTAACATATTAATTTGTAACTCTAATATGTTTTGATTTTCAATATATAGGGTACAATGTGTATGTTTGAAAATATAAATTTCTTCTACCCTATGAAAATAAATTTCTTTTACAATCACTAAACAACATACATGAGTCACTAAACAAACTAAAGTTGTAAAGTGTGTCATCTCTTTATAAAACTTGTGTTGCACCTCTTTATAAAACTTGTAAAGTGTGTCTCAGTGATAACTATCAAGGGCTCTTTGCTTCAATGTTTAGTAAACAAAAAAAAAAAAAAACATAACATTACATAAATCTTAAAACTAGATCACTGATCATCATCCTCATAAAGAACATAGTCTTAAAACTTGATCACTAATCATCATCCTCACAAATAATAAATCACTAAACATTAGTTATGTTGTTTAGTGATTTAATAAAAATTATTTGAACTTTTCACACACATTAAAAATTATTTAATCAATATATATGTATATCAAAATAGTTTTATTCTATTATTAATTATTTAAAAAATATCTGTTATTTAAAATATCTGTTATTTAAAATAGGTTAATTATATTTTGGATTTCTAAAATATCTGTTATTTTTTAACAAATATAAAATATTAAAACTATAATAAATTTACAATGGACAAAGTAATAATCATATAACTAATAGAATAGTTATCCAATATGCAAACATTAATAGATCAACTACTTAGAAATTTGAATATGTTTGACAAATTCCATTTTTGAGTTTACAACGTATGTCTTATGGCAGCTGAAACTATAAGACATAAAATCAGTGGTTGAATTAACTTATAAATATGAAATGACATAAAATGATATATTTAATATATATTAAATTTATTTCAATAAATGTTACAGGGATAAAATTGAGATAAATAATGATAAGTTAAAAGTTTTAAGATACGAGATATTTGAATTAGCTTATCAAAGATGATATAAGCAAGTAAATAAGCTTACTCCTTAATGCTATTTTGACATAAGCTTAAGTAAGTCACCAACATAATGAACAAAGGGGGGTAGCAGACAGTTGAACCCCAATTCAAAGTTCAATCTGTCTAGAGATCAATCTTTTAAATAAATCTCAGTTACTAAGAGCGGATAAGTCTACATAATTACTCGGGAGAGTACCTTTACTTTAAAAATAAAATAAAAATTGAAGTCAGTCATGATGCTTCTTCTACAACGCAAGCAGAAGGATTCTATTAGTTTTTTTTTAATGCAGATTATTTGCAGTGCATAGAAACTTTTTAAAGGATTTCAATTGTCGATAGTTGTTATAAAAAAACAAACAACACAAGATAGAAACCAAATTTTTGTTGATTTTTTTTTTTTGGATGTGTATATTTTTTTTCCCCTCAAAACAGTAATATGTCTATTTAATCCCTCAAAAAAAAAGTAATATGTCTATTTAAAAAGGTATGTTCGATATAAGAACATCAAGTGGCTGTAGTTTAGTGGTAAGAATTCCACGTTGTGGCCGTGGAGACCTGGGCTCGAATCCCAGCAGCCACACTTTTTAAAAATCAAAACAATTTTTTTATCTTTTTATATTTTTGGTTTAGTAAATGTGTTTTATTCATCCATTAAAAAAATACCCATCATGATCATGGTTTTGGTGTTTCTATATAGAAGAAAACATACCCAAAAAAGTGCAAAAGCAAATATGAGTTGCCATTGAAAAATATTATTGGTTAAATATTAAGTAAGAACAGAAAGAAAATCTCATGTTAGTATATTATTGTAGATTCTCCTAAACATACGGGTACACCTTCAATTAACATCTCAACTTAGGTGGCTTATGAAAACTTGCATTGCCATTATAAAAGGAATTCCACAAAGCTAATTCATTTTCACCACCCCGAACATCTTTCTCCTACACAAGTCTTGTTATTATTTGGATTAATTAGTTAATTTCTCTCTCCTTTCTTTCTCTCTAAAAACTTGAAAAATCAAGAGAGAAAGAGAAGGAGAGAGAGAAATAAAACAACAAGAAGAAGAAGAAAGAAAATATTAAGAGAAACATATATGGCTGTTTCATGTGCTTCATTCAGGGTGGTTGCCTTCCTTGGCCTCATTTATGCTACACTTATTTCTGTGGCTTGTTCACAATCCATTGCACCTGCCCCTGCTCCTACAAGCGATGGTAAATATTCTTAATTTTCTCTCATTTAATTTTTAGATACCATTGTTGATGTTTGATCAATTTTTATTTGATTAGTTAATATATTCATATAACAAATATTTTTCTAATGATTACAAAACAAATGTGAAAATCGTTTGGAAGAACTTGAGTTTTTTTTTTTTTTGTTACAGAAGAACATGACTTTGATGGAACAATCTTTAACCAAATTTTACTTACCTTTGTCTTAATTATGGATTGCCAAGTCCCCTTCCCCAAAACTAAAGGGTTGTGGCCAAAAAATTCATCATATTTAATTTTCAATTTTTTATTTTTCCATGCTATATTCTTTATGAGCATTATTGAAAGGAGAGTATGTAGTGAGTATTGCTAATGAATTGTTGTTGTTTATAATATGCAGGCACCAAAATTGACCAAGCGATTGCATGTGTTTTAATGCTTGTGGCTTTGGTGTTGACCTATATCATTCATTAATTTAACCACCAGAGAGAGACTCCTTATTCAGCTCTAAATTCATGAAGGGTTACAGAGCCTAATTTTAAAGGCAAAGATAGTTATTCATTCATGTCATAACAGAGAGGAGGATGAGATTTTAATTGGAGAAATGAGTTGTTGTAATTCTCCTATGCTCCAATGAGAATTTCATTTTAATTTATTGGTTGATCTATAGATTATTGTGTTCTGGTTTTCAAATAAAACTCCTGCGGTTTCTAGACCAAAAAAAAATAAAAAAACATGTTAAAAGACTTATTTTTTGCTGTCGAGTAGCTATTAAGATTTACCAAATATTGGAATATAATTTCTTGGATTTAATTTGTTGTATAGGTAAAAATAATATGTATTCAATTCCAATCAAATTACATTATGATGTTATTTTATTACATTAGTTTGAAAGTGTATAAAATTTAATCTCTATTCTTCAAGAGATTTCTCTATCTTATGCAAGGCTATGGGAGGGAAAATGACTTGCGATCAACACCTTTGAACCTGTTAATCACATTTGAAAATTTGACATTACGACGGCGTTTGGTAATTTATGCAGAATTGCAATTGTGTGCTGTTTAATTACGTATTGTTAGCGTTTTCAAAGACCAGCTACTATTTCATATGCAAGTATTTGAAGGATAAAAACATTATATAATTCAATGGAATTCATTTATTTTATTTTTTGACGAGATCAATGGAATTAAATTTGTTATTCCCACATTCAACACCAGTACATTTTATTCATATGATATAAGTATTGTTCTTTCATATGGTCTATTTATCTCTATAGCAAATGGTACTGGAAAACTCTAAGTCAAGATAGAAAAACAGGTCATCTTTTTATTGGAAAAGCTT

SEQ ID NO: 30 - protein, 228 aa, Medicago truncatula
MFLSPVPTFWRIIKKKSTEEFSSFPYICTLLNSSLWTYYGTIKAGEYLVATVNGFGIVVETIYILLFLIYAPPKMRVKTAILAGILDVLILAAAVVTTQLALEGEARSGAVGIMGAALNILMYGSPLAVMKTVVKTKSVEYLPFLLSFFFFLNGGVWLLYAVLVRDSILGVPNGTGFVLGAIQLVLHGIYRNGKQSKHVSNKLEEGWQHEHLISSSTTRSHDRENLPI

SEQ ID NO: 31 - protein, 269 aa, Medicago truncatula
MDPHDHDRLAFIFGILGNIISSMVYLAPLPTFYRIWKKKSTEGFQSLPYLVALFSSMLWLYYGFVKKHAFLLITINSAGCVIETIYIVTYLIYATKDARILTIKLFMAMNVACSVLIVLTTQLAMHGKLRVHVLGWICTSFAICVFAAPLTIMAKVIRTKSVEFMPINLSFFLTLSAIVWFFYGLLLHDICIAIPNVLGFILGLLQMLLYAIYNKSVKEEYALEPMTNIVIVNPLGIPCEVFSLPVIDNVNKIEKEGAEEMEKSVENLT

SEQ ID NO: 32 - DNA, 810 bp, Medicago truncatula
atggatcctcatgatcatgatcgtttggcttttatttttggaatactaggtaacatcatttcctccatggtgtacttggcacccctgccaacattttaccgaatatggaaaaagaagtcgacggaaggattccaatcgttgccatacttggttgctctattcagctccatgttatggttatattatggtttcgtcaagaaacatgcttttctactcattaccattaattcagctgggtgtgtcattgaaacaatatatatcgtcacatacctaatctacgccacgaaagatgcaaggatcttgacgattaaattgttcatggcgatgaatgtggcctgttctgtgttgattgtccttaccacccagttagctatgcatggtaaacttcgtgtgcatgtccttggatggatatgcacatcttttgcaatttgtgtttttgcagcacctttaaccattatggcaaaggttattcgaaccaagagtgttgagtttatgccaatcaacctatcatttttcctcacactaagtgccatagtgtggtttttttatggtctattgctccatgatatatgcattgctattccaaacgtgttgggtttcatattagggctacttcaaatgttactatatgctatttacaacaaaagtgtgaaggaggagtatgccctagagccaatgacaaacattgttattgtgaacccattaggaattccgtgtgaagtattctctctcccagttattgataacgtgaataagattgaaaaagaaggtgcagaagagatggagaaaagtgtggaaaacctaacatga

SEQ ID NO: 33 - DNA, 145002 bp, Medicago truncatula
tgtagatgagggaggaaaaatagtgacggtggggggtaaggtgaagtgtgggcaagggagtagtggtaaggtggcggatgtggtgagggaggtggggaaggccgtggtgcctgtagtggaaaagcagatgatatgtctttggatagaggaagatatgattatgtgcgagttctgatttcgataccatccttagatattgcttcatgtgttgataatttactaatagatggaaatttggtataaataaagattattgaggaatgaggacttgatattggagaagatgtgtgtctttttgaagatgacgaagatcagaagtctcagtcagatcatgtggaggttcaaggtgatccagaaacttgtaaaaatatggatactctagttgacaaacttgtgaaggagatagaggaggaggttgtgaattcagactctgaggcaagggacgtcgatagaacggacgatgttgttgaagcagctatacctgcgacattgtcagatttggggtcacaaactcaacctgaaaagggtgtcaacatggcgacaccatagagttctcctgtggttgcagtgttgcgcccgtggatcctgaagtcgatgaaattttagatgatggaagtgtgttacatgatgaaggtattacaatagaggtgaaccatactgatactgttagcaatttgaatggtgagatcggaaaacaaaatgtggttcataaagagggtagtggacatgtgtcggttttgtcttgccccctttttgcaggcaagtctgtggtgtccggtccgtggagtacagaatggttgaaggatcgccatggaggggctggtattatttttatggccaaaagaaagttttttaaagtgggaaagagaaaagtgaataatgttccagaaggaggtgttggtcttgcttagcagcaagatgattcttgctcttgctcttccttagcaccttctttttccttaacagtggatgattcttgctcttgcttaacaccttcttcttccttaacagcagatgattcttgctcttccttagcaccttcttcttccttaacaatagatgattcttgctcttccttagcactttcttcttccttaacaccagatgattcttgctcttccttagcaccttcttcttccttagtagtagatggttcttgttttttcatagcagaggatgttgcttgtttttccagaacagaagattgtgcttttccttcttgagtataagattcttcttgttctttcttagcagtagaggatggttctttttccccatcagcagatgatgatggtttttcagcagatggagcagatgatgatggttttccagcagatgtagtagatgatggtggttttccaacagatgtagcagatgaaggtggttttgaattggatgaaggatgtgaaatcaaaacccattcattgaaatcttgatcgttctttggtgattgagccatgttaagaggtttctcttctttctcacaaaattgagtatacaaaatgtgaagtgttatttatttgtgaaacccatcgttattatataatggtgctggaaacttgcttcacaagtaactctaactgtaactaattaaaaaaaaatagaaaataaataaactctaaatgtaatagacttctaaccgtttccaagttcgttattggttagttttaactgtaactaattcaaaaaaataaaaaataaataaactccaactgtaatagacttctagccgtttctaagttagttattggttagttttggcagttagagtgattaatgacatgcactacactaactcacacttgatgaagcttgttaatttaattttgtgagttaaacataaaaatattaattcattatgctatacttttgtttgtgatttcaatttcagtaattgtcccattatatccctggtatccttccttcatttcttaacaaaaatttgttttcatgtgaattttaaacaattcatggaaagcctatgcatatatggaaagcctatacacacacgtatgcataccaatataaaagaaagagcaaattcaaaccctattcaaacagaaaaaatatacataggaaagagcgtacaataataaaaaaagagctcctcttcaaataataaaaaaagagctgaaatatagtacctataaaaaattggtggtagagatattttactttatgaaattgagaagcaagattaaatgactgagttaaatggctgtgcctttttaaagagcattgaatacaatttttttttaaatttaattagttgacttatatttcgttttaattgaagtaaaaacaagtggaaaatgttaatttaatgctccttaactagtgcccgcggggcactagataacattaccctaatttctttttgctcttccttcccgacaatttctgtcgggatgaatgaaagcaaaattccgattttcataacttgcatgtttatagtcatcttcctaatctaagtagaccacaaattttttatgaagaagatcaaccatgtgtatatatccctaaccttcgcccaatagtttcgcaatcgagcctcctaaaaacaccctttaaccctcttccctaacaagtgcacaaaaataagaaatttcggatgaaattatatcatttcatatttttattactatacttttaatttaaaataaacatataattattttagatttttttttttttttggttgatttaagaattacatttgatttaaaatgtaaattaggattcgattgaaaaaaaaaaaaaaaaaaaaaggaagtatgaattggataatcaaatgtaaattgtcattcaattaaatttataggtatatataatcaaccaaaacaaaaaataatgttaaaagtgtaacacaaattgttatacatgtataaccagagcaacgcgggcaaaatacactcataagaatatgagttggtttatgatggccatataataaagtggaaagaaaacttccatcttttcatctcaaaatttgtcacctacatatgttgccaatttattttcttataccctaaaaggaattttaaaatttgttcttaccgacataatttatcctgaaaaatataaaatcattgactgaaatgcgactaagaaatcaatgattgtattgtacataagaaaattccatgactatttcatacgaccgactatcaatgaaagaaacaattatttggtcagcccattccttgaaataatgtttctctagtcagtagcatcactaggaagatccggaccatgaggaattttgccaggataattggtagttgaattatttgatccaatcatactgcaaatgtatatataaatcacatgaattttctgcatatgcttgaattaaagttttatcatatgttattcaaataaaatgcttaccatttatccacaataaccatggaacgtagttcacaattagcaaagctgtcaaacatgaaaaccacattttatcaatttgtccaatgaaagtgtaacatatgtggggtatgcactttcaggagtgatacttactgtgcacacatttcagtcttaatatttgggtgacagtcatttccaaaagcactaagggtattaaacagaaaactgctgtgtgtaacaacagctatctccttctctttacgtgtacacaacctgaaccaaatcaataaagaaatttgagaaaaatgatatcagatctttggttattcaagtatcacaaatgcaagaaacaagctctttagatgcatttcaaaatcacaataatatcatattgaaaatatgaaatcctaacttaaagagaattgtagtgatgctttgataaaataaattaatcacactcaccattccaaaaacttgagtcctctaccagtaacttcttctttcttctctctttcaggtttccaccaagtgtcgtcatcagtttcaatctaaaaagatttttagcacaattcatattcaatcaaattttaattttttttgtagcaatagtgtatcagaacaaacttaattacagtaactgcagctagaccatatcatgaggtaagatataaccaaaatatcactaaccaatgaaaaatcaattcctggaaacatgtgtcggtactcgctgacagttcttctcttatcacatggatggagtccctggattacaaaaaaagccttgtaaataagtattttgatttctttagttaaggacattttaaaaaataggaagataggtgaagtctgttataaactctgcacactcctttaatcgaaggcgttccggtatctgacacgtacaagtatttgatatcgacacatgtaattccatttaattaatttgttttctcaaatcattaccggtgtcatgtcatgtgtattgtctgtgtcagtgtttaaaaggttataaattataggaggggaagtaaaaatttctgttatcttgaagatgtactagtagataggaacagttaagaaaccaagggaaagattgttgtaaactagttgattcaatcatacaaactctaaagaaaggaaaaattgttgtaaactagttgatttaattatccaaactccaaagaccaaagctacacattgctcatgaagtggcacatttttatcataccatttgctctcggcaaagctcgactgcaacgaatggtgggcagtttagactagaaactgcaggatgatcactgtgtcccacattttcaatcatcagaggaggtttattaactccatcagtgtttgcttccccaccaaagactccaacagccgtttgcattgtcctgcaatgcaatagtttgaattttaacttatgatagtcccaaatacagatgcactcttatttgctgaccaaatgtaaaagtaataaatatagcaacaatgtcataactaatactcctcaagatggagtaaaaacgattcctaccaccaaccaaaaggtcaaattccatctcaatatcaatactaattctcgataactcatgatacacacggtaggctactcgatgttatttccagttggtttttagaatcaactgtatgactggcggagattataaaaatagtttataacatgtccataagttattttcagcttatttctacaagttctccgggatagcttataaaaatagcttatacggttatacctaatatgcaaataatttgattttatttcatcttttgttataaaaatagcctatatataaccacttaagtcataatcacttattctataagagcttagttaagctgtttacccaaacggggattaatgtgtcttgttccacatgaccttttttcattctaatctactgtaattagcttctttgactctcagtaggctccatagagtatctctacatactaaacttagctcttttgggcctattatgaggttaattctcaagtcagctgcggaacgttcggttttttggtacagttaaggatctcctaacagggtgacttcaagaatagaactcaggttcttttcttagaaaagagttatgttaccaactctctcaacacgtgggaggtgacgcatgatattaggcgatatagcgcaaggaatcatggagaatatttatattgtataactcagaaccgtcaaaattgcaggagtataatcttcccttcaaagggaaatgttcactacaactaattacagttcttacttataagaattgagtaaccttctctcctagtatcccccttatctcttatcttcccattctctatacaaataattattggttgtcttgttccttctagaatagatttttactgctctctcatccttaccactaacagaactctttgaggtactgtattgaatcttgagattcttgaacaatgcaccaggtaaatatctgttttttcttttaaaataaaaaatataattagactataaactaatgaaaactacgttgatgctgattggcctggataagtcatgtcatgcaccatatattaacattaggatattgctcatttatgtggtgaaatttggtcacatatcaaagttaaaaacaaaatgtggtcggaacttggaatgaacaatattttatgttgaatatagagctatgaatcatggagcatgcaaactacggtggctaaaaacaaatattgaagaaatggagtttttcctatcaacttaccaatgatgctatatgtgataataagactgctaaaagtgttggttaaaatccattatatcttaatcaaaccaaagcatgtgggaaatgatagaaaatttgtataagacaataagaatacaaaagaagaaattatgtgtatgccatttattacaatcactcaacctaactgaacatattgtaaggaagtttagaaagtttcttagtattaatagtttgaacctatgttttagtttagatagaataaaatctgaattatcaaattctgatatgataatttgtttttatctcttatctttctcttttctatttctttctcaagttgtagtaaattggttagcatttttctaaccaactccggctttacatccaatccttgtattgtatctcatcacatgaataaacaataaagaagtaaaataacaaagtcagacatatacatgatttggcgaaattcctaaattgcaataagtaccttaacaatggggaaaccacaactagttcaatttttttggaaagtccaatagccttcacatgcttttgcagattttcaacctgttatagagcctcaaagtataagtgtttcaccatgacatttaaagaacataaaattgacacttgaatcatcgactcagacatggacatcagacatgacactgatatgtggttgctggtaataatttgaaaaagtggaaatatttgagtataaccgcatgtatcgatgtcagacgatgacatatatgagagtgctacattgagcaggaaatactagcaagagatagatgtatgcagaacaagattgttatcgacaattacttcacgagaaatcggattatggaataccaggacagaatactaaaatactaataccaatctctacaacaatatcatttgatcatcgtgatcacttcagagaggaattccgcataatacaaaaaccattgacaaatacttgacagcatgacattcaaaaaagttggaaaagcaactacctgctgccatccaagaggagttaggtttgcatcaaaaaaatcataagataagtaagcatcatggttcttttctccttctacattatgaactccttgggcatgcctaacctgtatacaaggtcataaaatacattagtgctataaaaaatatagaaaatcataaatggtttcaagaaccagaatataactacttcaacacacaagctatcaactaatctcttaacaaccaaatcagacattgaaccggcgggacatctaggtcatggttcaacttccttaaagcgcttaaatcggaacaaagctgcaattgtactgccaataatatttgaaccgtagtaaaggccggttcaaggttcaaccagttgaataatctcgtttgatttttcaaacactactattaggaaggatctagagataaatgacttggagaaaaacatgttttctgatagaacactatggcgttgtttgattcatgtagccgaccccacttagtgggataaggcttggttgttgttgttgtattaacttatgtaatgaaaagaatggcaagtccctggaattatttaccgaaattttgtccttataactgaatttcatgctgttctaatctctttgatcacatagaagtttatcttattatgtcattcagagaatgataagtggttaactctagtccatatataaaatcagaggtgagtaaggctttggatttcataccacacattaaaaaacacaattttttgtatgataaagaaaatacaaatctgcttcaaatataaatttgccacaaaccaggtgaatagttttgctatggtgcaatggatagagactttgaccaggtgcagtatccataactgcagtcacacaaaaacaaaaacgaaataaaataaactcaattgatgaagttgttactaaaccagtctaatgaaaaagaaaaaaactgcacactattatgcaacacaagcacagattagttaaatagaaggaaaaaaatcgcaaaaatcaagccgtgattcctaaattcgagaataatcctatctgaatttttgaccgcataaacgtaagaatatttcatggtacctgaacagtgtaggttatatattctcaaattggaatagaaaccaaaggaagtgtgaaagagtttgagcaatgtggtttagctcaagtggttagttagcattagttatccgagttcgaacactgactagaacacaatttttgatcggacgttacttatctttcaatcgaatttcatattactagcatccatttttcatatgaaccatatggttaaaaataaagtttgatcactgttggtacctaaagcaaagttactacgttaaaaagatgccaaaaagcaagactccacatgtgtttcatcataaacataaacctacctatttgtcctgaaacatacgtacgttaataacagtcacacaacacagaaaagagaataaaaaaggaatcaggaatcttacacagcatattctgagaataagatttgaaaccatgatgaaataaatatcaacaatcaccaactatgcaaaaacttaactttacacgtatatgaataaatgttttttaaattaaaatttcaactacaatatccttatgcaattcaatagtacttaatttaaacttgaaaatcaatcttatttatttagaagaatctagacagttacatgattgatctctataccacctgaaaatgaagttgtgaactggtcatatcatattatgatataattattccaaaagcttgaacttggattaacttatttgagcttaccaaatggaatactcagttgtaagctaatttgtgagagtttaataaacagcttatggaatgttcataagctgttttcagcttatttccataaactctccaagataacttatgaacacagcgtatagtttttttttttttttaagaggaacgtatggcttatacgaaagtgatttttaaacaacttaaacaaaaattctcacaattagttacgtaagtagataagctcaaatatgctaattgagatgaacaagtagtttatatatacaatcaattctactataaacacttatatcataagcacttaataagttgtttatccaaacaaagcctagataaaaacactaagaatatttgtattattacgtttctaacaataaaaataaatattcaactagttaagcgatgatcattgcataaacgtatatatatactccaaaaagcgattctacaatgaatgaacatgtaatacaaataagtagcgaaaagtggaacatgtagaatattgaattttgatttgaataaaacagtggattattaattaaaaaagtgattgtaaatggattatgagaaacatggttattgaattgatatatatataaaaaatggaacgtatatgaaaaagaaatgcgttggagttttgacgtaccagaaaagaaaaagaagaagaagtgaaaatgaaatgttgcagacgaaaacgaaagaatgaatgagaggtagagaacagaggaagcacgtgaaggataaaagtggaatttcatatggttgtcacatgtggaagattatgagttgatctatgtaattaaaataacagttgggcggttagtgattgagtgaaaccagagaatttccatggatccttgtttgacttttccctttttggatatttttagattaaatatgtatttttatgtgcttttaacttattctagtaattctttaacttgcaagtacaacccaaaattgtagattatgttacgggtttttgttaaccggtgcctcggagtttaaggaattctaaaaagaaaaatttaaattaaaaataacattttttttacttttgagaaattaattacacaatttcttatacaaaagttactatatttgttttcttaaccagtgcatcggagcattggttaacatttcccgggctcatcatcataatcaaatacttcaacaacatgcaaatgtttttattactaactatgtccctaaatatatgagctttttgcaaaactacggagattaagaaagtttgttgtagtattaaatttatatataattattattgtttttacaattttatccttaagagagagagttaatttatgttttcaacataatatttattgttgattgaagaaaaagatgcaaaataaataagggtatgttggtaaagaaatgattaatttacttcgaaataccaaagtggtcttataaaaatggacaatttttttttaaaagggtcttgtaattagagacggatgtagtattatgttaaaattattaaatgagtgtgaaagttaagtgatgttgtattgatgacttccggaatgtttttaagggtagtgctgacggcacatgttagcatttgttatgtttttaagtattttatcaagtcttttcttgtttgttttaagatattttggatgttttagagtgagtttataagctgatttaaaatgtcttataaagtaatggaagcaaaaagatggcatacaatgaagctattgaagcccgaacaatctagggaaattctatctcaagttctgaactcatgccaaagaggaaaagcacttgaaggctgaaatcactgagttatctctggtccatttgccctagtgcacatagtccatgcaatggtgtcaagaacctacaaaaattatctatttacgagtatgctatacccagaatattaggtatttagaatccttgtggctcagagtttatgcattgtcgagtcaaatgagatgttcatacattcatggttagtccaaatgacggtgatccgtgacggtgggatcactcagtaacatacattcgatatccaaaaacggtatcatatatatgcatatagagttgaattaaaacattacatgcatatgagtctatatgaaagatgtgtacatgactatgtgtatctatgtgaaaaatgtgtgatttgacgttggtgatgaagtgtgaatgttatgtattcaacttgatgataaattgatgatgtgaatacttgttaaaaaaaatatcaaaattgttaggtcgaccattgtggctaaaaattcagcaaaaattaaaaaactcagttacttgtttagtgcatgtggctagtgccccactcatgtaactatctatctttaaaaatatagagtacacttgcattaacgctctaagtcaaatttatattgtatagagacttcaaaggaagaccgtcaaaagaataatccaacaaactaagtcaatagcagcccctccataatataatacgctgtgagatttcaattatggtttttatagggttagaatattggctaattttctaacaaaaaaaaaaaatattggcattttataactatatgtccaaattcggcatcaaattgagaaacttctatccaccttctatgaaggattgaagagaacccatttattcattggttaatctattcaaaataaaggaaataggctaataaatcaacgggttggaagaattagacactcacaacaccacaataatatttgaatcccgattaaaagagaaactagtatttagtgctcggcaagccacaactatgattagatttagggaataaccctacagacaactaaaaattaactagtcaatgatcaacggagattgaatctagagataaggattaaactcccctaacataacaaatcaaatgttgaattaccaagagatagcgtatttagtgtccgacatatcttaccttgaatatgattgattataggaaatttatgaaaaaagaaaatgggctaataatgtgagatcgtgtcaatatttataaattattttttagatgatatttcttcatggtaaagtttgatatgatattttgaagggagcttctacggtgcagtcatgaagctgacttttttgaaaaagttaattttaatcttaatgtttgattcttttttaaattgttgattgttgattaatgatcaatagtaattcatcaagtaatgcttgcaacatcttggacttaaaagtactattttatcgttggcatcgagttgctgatatcatgtgagtgttacactttgtggggtgttacacttaaaataaggcagaataaaattagattaagtgtattcttgttaatctgatgaattgatgatattaaggagattgaacttttgattccactgtacaaacagtgggatgttactcacaatacttttgatattatagtgttaacttcactaatcattctaatgacttcaccatagaattttcatattttcaatacaccccctcattcataatgaatttgctacatggatagtttgaccggtgactggaattcgataaactttgattccacatgtgattttttaaaatctaattcatgtttacaaaattaacttgttaaaatgagtgcaactagtgtttataaaatcgattttcaccccttatctcctttcaatcaacgtgtgatttgagggatttttttcccaatgacgatcaaacaattttgtgagatacactattaattaaattgatattaatgacaattttacaaataccttcaaatgaattttaattttgtctattacaattaaaaagacaaacttttactaccattaagctcagctaagatcctctccattactataattttgaagagttttgatgtatatattaaataattgaacacccaccaattattatattgttttcaaaatttcggataacgaaaaaagaaggtaaaaaatgtagaggattttgactccattaagttggcttattgagatgtgaatggtcatatgaactaaggatagtgtctctcacataggctgtgagatccatgtgagaattcaattgtctataaataagagcagccatgtgaaatttcatgtgaaccctttctcttatttattcatgaaactccaacactagtactggtctcaagtctcaacataaaatggccattcttctaactatgcttgatatttttattattataactattaatgtttttgttgtattgtctcatgtatcctatgcaaccgataccattaccaagtctgcttcattgtctaatggcagcactttggtctctaaggatggaacctttgagatgggtttcttcagacccggtaagtccttaaaccgctatgtaggaatatggtacaaaaatatccccgttcgaagagtggtttgggttgcaaatcgaaacaatccaacaaaagacgattcaagcaaattgatcataagtcaagatggaaaccttgtgcttctcaaccacaatgactctcttgtttggtcaacaaatgcatcaagaaaggcttcaagtcctgttgtgcagctcttgaacaatggtaatttagtacttagagatgagaaggataacaatgaagaaagttttttgtggcaagggtttgaccatccttgtgatacactattacctggaatgacgtttggatataatcgaaaattagatttttattggaatctcactgcttggaaaaatgaagacgatccgtcttcaggagatttatatgcatctgtggtctttacaagcaatcccgaaagcatgatatggaagggctcaactaaaatctgtaggtctggaccatggaatcctctctctagtggagttgtcggaatgaaacccaacccgctttatgattataaagttgtcaacaatgaagacgaagtgtattaccaattcgtgctcaggaatagctccgttacctctatagcggtactcaaccaaaccctattgattcgtcaacgccttgtttatgttcctgaatccaaaatatggagcgtttaccaaatcatgccatcggatacttgtgaatattacaatgtttgtggagcaaatgcacaatgcacgattgatggatcgccaatgtgtcaatgtttacctggatttaagccaaaatcaccacagcaatggaattcaatggactggacgcaaggatgtgtgcgcggtggaaattggagctgtgggattaaaaaccgagatgggtttcagaaatttgttaggatgaagttacccgatacaacaaattcttggattaatctaaacatgacacttcaagattgcaaaaccaaatgcttgcaaaattgttcttgcacagcttatacctatctagacccaaatggagcagtcagtggttgttctctttggtttaatgatcttattgatttgagactttcgcaaagtagcgagggcgatgatctctatattcgagtggacagggattcaaattttggtaagggcttttaaaatattttagtttttgtttaacaaacaatagtgaactcaatactttgttaactgtgaatataggtcatatacatgggcgtgggaagaaagtggtcatggtggtttctatcacagtttcaatgttgcttgtgatgctattggtattatcctatgtttatatattcaaaccaaagcttaaaggtaagattcttataaaaatttcttttcagttttgccaaatttgaagtcatgaaactgcctaatttcttgagttgttcataaagcaaaaatagtagtttttttttttaaaataagcaacagtagtagttgaaaagtaatcatataagtttataattacatacatcgacttttcaactactttttttgtttatatttcattccgaagtaacaattttacaacgtaactatttaatcttttcataatatattttcaccctagaaattaggtattgacatacttttatgcatacaatcatatgactttatgtcaaattttatgattgtttctaaatataagtttctatattcaaatttcattgatcccatctaataaatcaaagggaaaaaagaaagagatggaggagaacatgaagattttgatcttcctttctttgatctagctacaataatcaaggccactgataacttctcaaccaacaataagcttggtgaaggtggatttggacccgtatacaaggtaaagttttaacatctctaataataaagataaaaaaagaacttcaacaaaaaaaaaaaaaaaaaagactaacaaatttcattattttccacttcttctcaactatgaaattcaggctacattgcaagatggacatgtaattgcagtcaaaagactttcaggaaattctgagcaaggatcgaaagaatttaaaaatgaagtcatattgtgcgttaaattgcaacatcgaaatcttgttaaggttcttggttgttgcattgaaggagatgaaaaactgttaatctatgaatacatgccaaacaaaagccttgattcatttctttttggtttgtaatttttttaaaagtctaatatttatcataataaaatgacttcttttataggattgaaaaaaatatataaccatttcattgtactatcttggcagatccaactcaaagtaaattgttaagttggtcaatgcgtcttaacatcttgaatgcaattgctcgaggaattcaatatcttcatcaagattctagattaaggatcatacatagggatttgaaggcgagtaatattttactagacaatgaaatggatccaaaaatttcagattttggcatggctaggatgtgtggaggtgaccaaattgaaggaaagacaagaagaatagttggcacatagtaagtatattataaaaaaaaatttaaccgtaaataattatcgttatattgattcttgtgtgtttcctttcagcggttatatggcacccgaatatgtgattcatggacttttctctattaaatcagatgtatttagctttggcgtattattgcttgaaacaataagcggaaagaaaaacagaacacttacctaccatgaacatgatcacaatcttatttggcatgtgagtacaaatatgaatcaatgattttcttttgctaaagcaataaataacaagttattaatttttgttaggcatggagattgtggaatgaaggaactccacatgaattgattgatgaatgcttaagagacacatgtgttttacatgaagctttacgatgcatccaaatcggtcttttatgtgtgcaacatgttcctattgataggccaaacatgaaatatgtgattatgatgttggatagtgaaaatactttacctcaaccaaaggaaccaggtttcttaaatcaaagggtgttgattgaaggacaaccttcttctgagaatggaataactatatcactattaagtggtagatagagaaactagtttatttttaacattgttttgtatcttgtgtttgagaatttaactgttcactaggcatgacaaatttttgttgttattgcatggacatatgatgatgtatgattgtgttttctctagttggaaacttttaagaagaacttccaatccaaagtgtcaaaaacctttaaaataacagttttcagaagccaaacaaacacaatctatgatttttctcctatgaatggacccattttgctccttagaggtgatgaaaggcataatttgagctaatctaatagcaatcacctttgtaattatctcgaacttgaaattgaccattgatataggtctagagtgcttcacggcctcaacatttagtgattcacgaatcaacaccaaagtgttagcagtgaagtttggcaacatccaaccagaggtgaagaagtgccaaactgcattggtaacatcttcgttgacaatagtccaataagtttgatagaattaagctccaaagtcattagtagcactgtccttattaagagagaaaacatttttttatctcaatttaagtatgaatcattgttaacaacactacacgaaataactgattttcctatgaatttattcgttgaaaaacatcctaaattcgtcagaaacattgatttctgaggaaattattgatctatttctgcgaatttccgaggaaatattgttgttctggatcggccaaagcctttatgcccaattacttaggcccaatacaattacaacccaaatccgcatttggcaatattactcgcaacacaccccttctccgtgagggggtgctcggagcaactgagaccagttcaaacgaactgtaacgtctctgcccacgttcccacaaatctctcctcggtggttacacttcctacaaattcgtaaccgccgagcacacgtgtgccttacagcggctatgcaaacacccacctctatataaaggggactcttcgcagtcaccaaggtagaatctatcttctctctaaacccccattctgatctcttactgacttgagcatcggagtgtctgccggtacacacccccgtcggtcaccacattatatagcaccgtcagtcaccttctgatcaggtacgaccagtgacgccgtctgtggggaataacaagttatccttggtttttacatacaaaaaaccaaggctttccaaactaaaataccatgactgccaacagtgccaacccgcacatccagagcgaaacccgtcgcgtcaaccgtgacggacagaccgccactccatctcatgcaaccaaccccgaacgaggaaactcgctgccgagtccccaaccagcgacacatgtgcagtaaccgcctctctacggtcctccacgacctgacgaggtggcagacaattccactcctacagaggcgtgggtcaactacctgctccgcacggttcaacaccaaatgtcgataaccgaggagtagaatcgacgccttgctgacttagagaaagagaggtcaaagaggcagttgacccccctccatcaagctcctcccctaacctgtaacagaagagaaagcagctttcgcccttcccgatccagatttctaaggtacttggtcaacatgagatctcccagccatggtcgtcgctcacctcgaaggagatctccctgacgatcctctacaaggaggtcacaacccaggcgcaacaggtgctcgtggtcctcgtctgactcagaagatgattgtgatgctcgcaacgaccgtgcaacttacgattctttcactcgacgcatctgcgacgcccaaatcccgcgtggattagagaaaccaccccagatggactcttacgatggaacgacgaatccggataagcacgtcgagaacatcgaggttgtcctcacctatagatcggtgtggggcaccatgaagggtaaactcttcgttactaccctccgacgacgtgtgacatgagttcacttttcatttcatcgattcgagtacccaacccaagattgtggcgtccctcgaagcaatagtgcaagggaagagcgagcctctcagagactgcatcgagaggttcaataaagaagttgtgcaagtacgagatgccaacgaatcaatgaaaagcgttggagatatttccttaatgataagcgttggagattgggaatgagactgtggagcttgatgaagatgaacccctaggaaaaggagtaaggatgctcaaggtccatcataaggtatgaaaattctgcatacatgtcttattgttccgatgttgctttataaataaactaaatattgaattagcccctaacaaattgaacgcgactcaatgtagtttatgacaaaagtaatactcaaattacttcctgacaaaattaatatccaaattagtctctcacagttacatacaggtaacacattagtccctatgttagagggtccccttgtggctgcggtgttcttgaatactatacaacatttttgaaataatatgcggtgtcctttaatattaattacataatcatttttgggtttcatccagtttgaattgtataatatgaaatattctcgttaaagatcagattattattttatttttttggtcttagatgaaatggtaatatagtgaaataaaactcacacacaattgtgaggtcccaggtcataacgtccgtccttgcaattttggcgtttatcattgtcagttgagttagaatttttagacattaaagatcagattatattagcgagttaagtgtattttggaaataaaaaaataaaacgtacaagaaaccaagagtgggaaagttatagcccaaatattatgaaactgagctattagccggctagaaatcctataaaattaaaaaaaaaaaaaaaaaaaactttttgctagtgacccactcatgtaactatctacttttctataagaagaaattaatgtatgaaatattaataaatttgtggagtctttcctcccttaaaccatggaattgtttctattttttaatagatagggaacacttacgttaattaacgctcaaaaacaaatttatttttcggcaaaaataaatgatattcattcattcaaattgatatagtacattgatataatgcaaattcgctaaaaaatgaaagacgacgaacaaaccaatgtcacaagatgacgacgaaatcacaaaataaaaaacgaaatagatataaaaatcatttatttcaataaaagggaaagatacgagttagataagtgattttgggtcaaaattgactctaaactacccctatttaatggatgaaggtgaagaaaatagagttttgatgacggctcacaaaagagaaagggaaaagagagctacactctctaaaacaagtttatattgtatagaggattcaacagaagaccgtcagaaaaaaaatccaacaaactataataaaatctttgccaactaagattaccttaatttatgatctaaaaaccttaattagaaccaattatttgagatgtcaacggccttaaaataacaggacccgtttatagtgttggtatatcttgaagtacgttttaatgtcaagtcaatagcagaccctccattatatacgctgtgagatttcaattatggcttttactaagtttttaaatgagttgaaatattgcactttattatagaaaatagataggatctcaactcgattttttagtgttagaatattggctaattttgtacccaaaaaaaaaaattggccttttataattatattaaagtgagacatttctctccacttcttatgaaggtttgcagaggacccaattattcattggctaatctgttaaaaaaaaaaaaaaaaaggttaataaatcaagaggttggaagaactagacactcacaaaaccacaaaacaaaatatttgaattccaattgaaagagaagctagtattttgtgttcgacaaaacacaaatatgattacatttagagaaagaatatccaaaaaactaaaaattaactagttttttttttgagagagaaaaaaaaaagattaactagttaatgaccaagaaagatggaatctagagatagaagaaaatgtcgaatatatcacatttagtgtcgggcatgccttgccttgaatatgattgattatctccatagaagaaaggtgacaactagagtatccatggaagaatggtgggtaatttaccccaaccaatacacattagccacataagcacatttttaagtggtattcatgaactatcttgaccccaccaacaaattgcattttcattggttgatggataaattacccactatccttcaaaggtaatctagaaaaaacctagaagaaatctatggaaaaaacaaatgggttaataatgtgagattgtgtcaaattttataaactattttttagataatatttcttcattgtaattttttttttcatacacccccctcatttataattgaatttgctgcatggatagtttgatgataaactttgattctatatatgtgataattttattgaatctaattcatgtttaacaaatcaacttgttaaattgagtgtaactagtattttacaaaatcgttttggaagctaaatggatcattttttataaactattttcacccatcactttttttcaatcaaaagtttaatgaatatgcattgtcgattaataattattttacacatatatgtaatgatacgttgacacgtcaattaatgaatatgaaacatataaattatcatattcattaattaactgacgtgacaacacgatattgaatacatgtgcaaaataattttaaattaaattgttgacatatagtaattaaactcttcaatcaaagcatgatttgagttttttcgtgacaatcaaacaattttttagatgtactattaattgaattgatattaacgataattttacgactatcttcaaatgaatttaaatttttatgcatatactttgtttacaagaaattttcatgtatttataccttaaaaacttcggtaatcgtaaaaagaaggtaaaaaatgtaaaggatcttgactccattaaattgacttagtgagttgtaaatagccatatgaactaaagatagcgtctctcacatacctttgagatccaatatgtgattggaattaagttagagcagcctatgtgaaatttcatgtcaaccctttctctttattcatgaaaccccaacacttcatttctttttgataacacatgaaattcctacactagtatccaatcaccataaaatggtcattcttctaactatgcctcatgtttttgttattattattattattaatgttcttattgtattatctcatatttcatatgcaaccgataccattaccaagtctgcttcatttcctgatggcagcactttggtctctaaggatggaacctttgagatgggtttcttcagacccggtaagtccttaaaccgctatgtaggaatatggtacaaaaatatccccgttcgaagagtggtttgggttgcaaatcgaaacaatccaacaaaagacgattcaagcaaattgatcataagtcaagatggaaaccttgtgcttctcaaccacaatgactctcttgtctggtcaacaaatgcatcaagaaattcttcaagtcctgttgtgcagctcttgaacaatggtaatttagtgctcagagatgagaaggataaaaatgaagaaagttttttgtggcaaggctttgaccatccttgtgatacactattagctggaatgaagtgtggatggaatcgaaaattgggtctagtctggaatatgactgcttggagaaatgaagaggatccatcttcaggagatgtaattcaaattatggtgcttacaagtaatccagaaagcgtaatattgaagggctcgactaaaatccataggacaggaccatggaatgctccgtcaagtggagtagtcggattgaaacctaatccactttatgattttgtatttgtcaacaacgaagatgaagtgtattatagatacacgctgaagaatagttctgtgatctctatagtgattgtcaaccaaaccctagcaattcgacaacgtctcctttatgttcccgaatcaaaaacatggagtgtttacaaacaacgccattggatgcttgtgattattacaacgtttgtggggcaaatgcacaatgcatcattgatggatcgccaatgtgtcaatgtttacttggatttaagccaaaatcaccggaacaatggaattcaatggactggacacaaggatgtgtgcgtagtggaaattggagttgtgggatcaaaaaccaagatggctttcaaaaatttgttgggatgaaatttccaaatactacaaattcttggattaatcgaaacacgacacttaacgattgcaagacaaaatgctttcaaaattgttcttgcacagcttatacatacttggatgcaaatggagcagtcagtggttgttccatctggtttggtgatcttattgatttaagaattttacaaagtagtggtcaagatctctatgttcgaatggatattgattcttcaaatttcggtaaatgatttcgaattgtcccgctaatatttctatttttgatgcattgaattaacaagtttctataaaaacttactattttgaagagtgcttctagggcattcattaacatttttcaattgtttttagtttttgtttaagaattaaattactagtgtagtgactcatttcttgtgaatacaggaggtcttgcacatgggcatgggaagaaagttgtcatggcggtttcgatcacagtttcaatgttgcttgtgatgctattggtattctcctacgtttatatattcaaatcaaaacttaaaggtaagattcttagaaagcaagattcaaaaatttatataattagtttaatatgtattgatctgaagttgttgtatggctacatttatttttttatgaatataggttgtaaacttgtgtacgtcttaggtaagttaaagataaaagataaacatttaataataaaaaataacaatataaatcaaccaaaaatgaattgattgaatttttaatcaaaagggtaattgcaagctacaaggaaggtctctgccacttccaaattgatgcccatgacacaactcttggaaaacttcacaggaaggcctaaagctaattaaaagcacctaagaatttgtatataagatcgaccaagggttgccatgtagctttcctcctagggttataactcatatggagtccaagatacttacaagggagagacctcatgctacaacgaaggaagctctctgccactttcaaaaaggtgttatccacatcgatgcccatgacacaattattggaaaaattcgcccgaatgcctgaggctaatgcaatgcagctaaaatcctcttaatctccttgagattttccatagacgcttctcctataaatagagtatcgtctacatattgaagatatgaaacgtaaaagcatgatgctcccatcgtaaagctagtatacaaaccaaacacctccgccttcttaacaaacataccaagtccctgcaccaccaaaagaaagagaaactgagtcagaggtagggatgtcaatgggtatccatgagtacaggtattatgatatatgtccctggcccattgaaaacatatggtgctcgttcctgctcctgtaacccgcgcgagtagagctatacggataatccacaagtattaaggtatccacgagtaatggcggatattcatggattttttaaaaaagtttttttaattacctaataacttcaatttttaaacatgtattttaatttcataagccatacataatccatttaaatttcgtaacccatacaaattgcataattcttgaagtccatacaaattttcaactaatcaacgtctacaaaaagtataaaaagccaaatcttatgtacaaaatgtataaaaagacatacaaattttcaaataataagaaacaagggttattttagaaagtcaaatatatatatatatatatatatatatatatatatatatatatatataaattgatctaattgattaatggatacagatatccctgggcacgagtaccatcaactccatatctgtatccataaagtaacgagtagttaaatatatgtttattatacccatagcccatagatacccccgataaaccacccaccttgtgcctgtgacattttatctgcaaattctcgcgggcatgggtattggcatccctagtcatatgatctctttgttcaagccctcgctgaatattaatcctttgcatgagccaacgattgactaaaacaaacgtattatcagagaaaacacacgcaagaatccaatcacgttgcttaaggtcaaaaccaaatctactcatcacatagtccaagaaacccttgttcaacgagtcaaaggccttttcaaaacctaccttaaaagaaggcagtttttcttcaacttccaagcctagttaacaatttcattcaccactaacgcaccatccactaaaagctacccttaataaaagacaactagttagaagagattaaccaatcccccccgcgtcaacactttagccaccagcttatatatagaggggccccagcagagttatgtgatataaattactcaacttctaaggtgagaccacctttgggaccaaggtcacagaaaaggagcaaaagctacaaagctgggtagcatgaaggtgaaactgctagatagaacatcaatcctacatctactttaatttgaggtcataatcttttagggtgtgtttgtttcaagtttaccaaatttatttctagaaataacattccttgaaatataaagatgtgaattttattccaaagtatttaaaaaaaaagatgtttggttaacattataatattctcagaaaccttaaaaatatacactataacatgtacttgcacaatttattctcacccttttctttcgggaaatttttctgctccatgaatgttttatattcgggaataaaatttagtaaacttgtaacaaatataggcatgtatatttctatcattttatttctaagaatctacgaatataacttgagactacacccttaaaaaataagaaattaaatccatttgaaccgtgctcatgttcccatctcaggaagtcacaacaaactctttaactcttcaatggttgtcagagaagtgatctgtaaaataccgcacaacttcctcacaaaccccccaccacatcttctattcatctccatgttggtatttagaagtgtagtaaaatatataaagttcgtatccacaaggattgggtcatgtttgattcctttctctttcacttcgcatttgggtccaaagtctacaatttttcgcttaattttatgctattttaataaaatagctaagtctaatatcttagtacgtaaccttcttctttgatcaaaatcgtctaatgttttaggtcagtctgtaacaattaaaggtttgattgcgtgttaaaactcttgccacaaaggtggtaatagaacatgtttaaagctattacatattgaataattaatattaggccaagtcccaaaatcaagggttaatagtcattcaaggcctagatcgatttatgaatattcataaacacgtaaaaagcatcaaggataaatattaaccataagcaattcaattgtattcaaagggaactcaactgataacattgttcaagtagttatagagaaggtaatctagagaactagttactcatggtaaccaaacaatcatcgtgttataattacatgtctcagtgttgtttacattcgctcatagctttacaaatcatgtttttgttgttttcttattgtcttagcatatgttttccaatgaggtaggtagagctgaaaataagtctagtcggatcgaatttatctgagctcgactcgataagaattagttcagctcaaaactcgactcgagttcgatacgaaccttttcttttaattcgagttcggctcgtttaaagttaacgaacaactcggtttggcttgttagattcaactcatttgttagttttttttttttaaattagcaaatatataattataaaaaaaaaaaaaaaaaactatggtgatgcagcagagtccgtatgatcgtatgctaccaatgcatgttttattactcggtgatgcacttctcttttatatatgctcttgctctctaatgtttttaaactctccgatgtgggatttatttagtgcacatattggttcaaaagcctgcactttagtagcttttttttcctctctcttttattataatttcgttgattgttaatcaaattagtaataattataatatatatatcgagttggttcatgaaccaaacgatttgaaccttatttagttcaagttcagctcgtttatttaacgggcttaattttcaactcatttagttcatgaaccaagttcaacaattcaattatcgaatcgtgtatcgaactatttacgagttggtttggttcatgccagccctagagataggtcctctcatgttataggcaagagtttccaatatttccaaaacagtatgtgcgagaagtgcacaatcttctacgcatcgtgcatgacgcaataattgtacccttttgaatgcttatcagctacacgacacatatggattaagaagtagttaaaccttatgttcttcctcaaacattataggactgatttcatcgaaaccccacacttgaactttttcttgacctcaaacaatatacttataaaatgaaattcaacaataaaataacgaacatccttaacgaaaccactggtttctattgcatttgttttctccaaagacttcgtttcaatcctataaaagaaaggggatattcaagatgccaagttgggaaataaaattactaaactcttgatttttcaaagctccacccttctagccaaagctatggaatgatccaattgataaggaatttaaaacccttaaggcagataatcttcatatcattactataaaacaaaacagttgattggttctaaaatgttgaattaaatattgaacaaaaaaaaacaccaaataaaaatttcttttccttttttactaaatttgaagttatgaaactacctgatttcttctgtttttcaaaattatatatatacacacacatcttcacacttaaaaatttatcaaattaaaaatgataaattattcattaaaatacgtggattatcatcaaattttattagagcaaaattctaaatctttttagttctaactgttaaataggcttgaatttcattccaaaagctagtttaaaggatgaggatactcaagcatatttatacactcagcagcccaggaacctaagcaatgtgagacaaataacaaacaacatcaaaaccaacttcagcacccaccctcttgcctagtgtgggtctgggtccaattcccacattgcaattcttaactcggctctcataccatattaacaatatagatacaaaatagagaatgagagaatgagaacaacaaatgctaacaaagacgactaggatttcatagaatattatcaataacataatattacaaaaggttataagaaaatatataaaatctaaagaatattatcaatagcattagattacgaaataaatcaatgttatgtatttatgtttaaatattaatccatagtgaattggataataatttttcactctacaaattaggaatttatatacttttatgaatacactcaaatgattttatgtaaaatattatgattgtttctaattttaagtttctactttcaaatgtcatcgatcccatttaataattcaaagggaaaaaagaaaaaaatggagcaggacatgaagattttgagcttcctttctttgatctagctacaatgatcaaggccaccaataacttctcaatcaacaataaactcggtgaaggtggttttggaccggtatacaaggtacatttctaacatgtctagtaaagataaaaagagaactaatgaatttttattataattcacttttttttaacaatgaaactcagggtacattattagatggacaagaagttgcagtcaaaagactttcaggaaattcttgtcaaggattgaaagaatttaaaaatgaagtcatattgtgtgctaaattgcaacatcgaaatcttgttaaggttattggttgttgcattgaaggagatgaaagactcttactctatgaatacatgccaaacaaaagccttgacttatttctttttggtttgtatttttttaaaatgtttgatatttattataataaaatgacttcttttataggattggaaaaaaaaacctaaccaattcatcgggactatcttgacagatccaactcaaagtaaattgttaagttggtcattgcgttttaacatcttgaatgcaattgctcgaggaattcaatatcttcatcaagattctagattaaggatcatacacagagatctaaaggcaagtaatattttactagacaatgaaatggatcctaaaatttcagattttggcatggctagaatgtgtggaggtgatctaattgaagggaagacaagtagaatagttggtacatagtaagtatcttatacaatataaattttaaagtcatgactatatcactatattgattattctgtgtttccttttcagcggttatatggcaccagaatatgtgattcatggattattctctgtaaaatcagatgtatttagctttggtgtattattgctagaaataataagcggaaaaagaaatagagcacttacctatcatgagcgtgatcacaatcttatttggcatgtgagtacaaatatgaatcataattttttatttttttttgctaaaacaataaataacaatttattgatttttgttaggcatggagattgtggaatgaaggaactccacataatttgattgatgaatgcttgagagatgcatgtcttctacacgaagctttacgatgtatccaaattggtctattatgtgtgcaacatgatgctaatgataggccaaacatgaagtatgtgattacaatgttggatagtgaaagtactttacctgaaccaaaagaacctggtttcttaattcaaaggatattggttgaaggacaatcttcttctaaaagccaaacatcttctgataatggaataactatcacacaattaagtgctagatagagaaaatagttaatttttaacattgtcgatacaatacttgcattttgggatttaaactagccatgattgtttttttattatagttatagctatggacctatggtgatgtatgattgtattttctatttaaaataaataaataataattgacaatgttcagaaacaatatctcgcaattgatattttgatgataaacaaagaaaatgaacaatatgtctaatgatagtgtgtttaagtgtgtaggttataagcattgaccagatactattaacatttatctttatcaaattttaagtgtgaaggacgttctatatctctagaaaaataacattgagaattctttaaaaataaagagcagccaattacaatgcactatttaccacaatttaagaagatgtgactgtaaaatagaaaatgaataaataaatcatgcaattaaaactcgctaactgtatctaaaaaaattcttgatgcatttgcttcgctggaaattgcatttaattgttttcttttgaagggtacagtccaatttccatttcattgttgtggtgattttggctttaaatccacgtaaacattgacaaattggtgatccatcaatgatgcatcgtgcatgtgccctataaacattgtaaatattacaagcatccaatgacaaggatgctagtttaagctctagaggctaaaatgttttatgtttaaatttaataactgtattatgattaattgattattcatttataataaaagacattttttttattatatttatttttaagtaataaattatctagaatatttgtccgattttctttttttcataatagttaatttgattaatgaaacattaaatgtgacttagtcctgagatcacattattataaggaagctttaatctgacgtgggataatgagaagagtaatgctagcaacattctcttttaaactctctaatactcattttcttattggtttaaatcattgtgggtctaaactttgaaaattgaaccaacacagtggtgggacatatattgattttatccaataaaagaattagtgttagagagagtgttgctagcattcctctaatgagaatgcatatagattatgacttatgattaatgtacttttaattttgcaagtattataacaatatatattggatttagaaaatttactcaaaactctcattcaatacaatttttttattcttccaaattaaaagaactttgtattatggaaagaaaaaaaaaaaactaaacccctcaaaatccccccctctaaaactctccatcatttccacttatttcttcctttattttcaaaccctctatttctctcccctccaaaccaaccttccaaacagaagtttttggagaaattaattttgccaaatgtcaagtatcttgtggtgtatctccaagaatctaaagccagcttaagaggatcctatttttgtgtggtgtgagactctttctgattatggaaatgcactacaacctaaaaagtatgattatgaaactcattgcttgtggcaatttgattatgaaattgttagagttgtaaagtattttgctttacacataagagttccaactttgatgtcgacttagaccttaaaataatattaccccacatagcccacaagaaaaaatgtttgattttatgtcagatcaattgggagcaagtcattttcaaccgcacattataattcaataatttgcctataacactcaaagcttttcttaaacaactaccaattattttgtccgattcacgattttgttttccatgaatagtcaaattcattcaaacattctagcacttgcattaaaggttcaaacttcaaatatatattcaaacaaaagaaaattgatttgaaaaggtcatttccctagccctaggttcgttgcaattgccatgagaagcaaagacaaggggtcgcacaaagtattactataattttgctaagctctcaagtggaagattaagttagtaatttaaaaaaaatcaagaatattcgaacattcccattaataagtaggtttgcttataatgattgtatttgattctttatatataaaaaataatgcttgttataatttatgagacatttgatatgttggaacatcaattttcttttaaaaaaaaaaatagaacatcgatttaaactcgcaactgtctacttcttaatattttgtgttcatgaatttcaccattagatctttagaataaaaaacataacttattatactaataaaaattaaaaaggactactttaaaactatctaaaatgtttgcacaagcattcaaggtctttttgtgtgaactccaagtactacacaatagcagcatgtacaattatactaaacaagtttcttattataagtgtttcctatttaatatttatctatgatatatgttatttaaacgatcattttttagacaatttatgggacaatcaaaaacatacaaagaaacatatgtattaacatgaagagaaatgctagaaacgatctctttattgcactttctctaacactcactctctcattcggtgaaactcgtgtagatctcaccactttatacggaatccatttcaaaagtgtggtaaccacatgaatttcacccaattagagagtgaatgttagaaagagtgttcataacactcctcttaacatgaaaaccaaaacaatagagaaaaagtaattacaaaatgattgtacaaatatcaatttcgtaagtgtgtgaaaggaactaatgaattctaaagacaaaagagatcattctctttcatattcttaatgtgtttttattctctccatagctttgattttgatgtcaatatatatatttttttatacatttgattgtctcgtaagtttagttgttcaaataatgtacatacttaattatttattatagtgcaagagatttggcagagtaaataaaccaaaacaaaaacaatcaatatgatgtgaaaattaatataaaagaaaattcatggaaaaagaaaaaggaaacacaaagcttttccacgacattgatatataacacaaaatcatttcatctttttaactttgctttaagaagtggacttgaatctatttttgaccgttagtagcccattttagaggcaaaacttaatgaaaattgatattttttagttcatgttgaaccttgtaggtcccaatattctagaaacttcaacattaaggcaagttcgttcactacactaagaaacttggctacacataaaaataataaagggaatcatacataaaaagatacttcataatattctaaaattgaattaaagaaaagaaaaaaagttggtttgaacttatattgcaactagccaaaaactataatttaatgttttttttttttttgagggaggattaactataatatgatgttggaatggcaaaattggttaacttgaacatgatgagtctgcctaactctaagatgagaggccaagttcatctcaatttcccaaaatgaatagaagattttatttacaagagaaataaagataagatttgtgactcattttgaaaactatcatatttttaaacatagagattaagataggttaagtatcttactagtttttgggttaagtataagtaactttttaagaaattgaccaatttcatctaattgtctctctatctaaacttaatcctccttcttctttttttgaggcatgatatacgtaacttatcttataagccgccaaatgcaagagtaatgatggctcataatattataaacaaaacacacaatgtagaaaaatacaatagtaatatccacaaagatttactccttttgttgattatcttttattcactttacttactttcttatacgttctctagctagtagaaaagaaacacacaagtctaggtaaaagaggatcacttatatctatataaaaataaaataaaaaagacacacgcaagtttaacttgacacttttaaataaattataataatcaatgccaaggtagaggaagcaaacacaactctagcttgacacttttcaagttttaattataagcccaatgtgtataatttgttccggaaaatagtagagtagattgaaaaatgaatgattttttaagagttgttggatcgaagtgaatgagtatttattaaacaatttaattaaaaatgaagtgaatatatgatgtatatgcagagtggtcatttaaactattctaaataagagcaccattgaagatgctctaattacttatttctgattgtaacgatttttagtcggatttctcttatcaccatctaatactttcaattataataagtatatattaaagaaaaaaaatcaagaacataataattgtaaggatttcattgctctttcctcaggtagaaatgcaggaccattctctttccgtacaaaatatgaattaccttaataaggtatacaacctcatgtcaacttcaataataaaaatgtcacactctttctaaggtccacccactaaaaagcacaccccaccatctctcacctaatgaacaatctaaaagcaaagttgccacattcatttcttatttaaatactctatgattccattcataattcaagtgaatccaaacaagcacaaatacaacactagctatagttagagtctaaagagaattagagaaatggaacttcaagacacagcagcagctaaaataaccattggtcttccattgggtttagcacttctatttgcttgtttactcttcatttgtgtcttcttttgttgcttattacattggaataagctcaaatttttctttccatattcttctggggttattaattctcaagctcagatacaaactgacttaacttcctctcctcagaaaccagcatttccttttgtggtaattatcttccccttttatttcttactaaagaacttaatattggaagttttaatatgttgtaatgaataatttttttggtaaatcacatatttataaatatataattttgctgttgatgttttttttttttaaatatgtttagcacattaaattaaaattaagtttttttttgaataaaaataaaaattaagttatgttttgaaatgctaattaatttttatattatatagtagtatttccttagtgccttccttaactagtttttttttgttaattatacatttattttattaatgatcttacacttataataatgaagaaatatactaatatatgagtgattgagtcaatgaaagataaaaatatatttcaaattttcttattaattaaaacaattttttctctgtttaaaatatgtgtataatgaatatttataaatttaatcatcataacaaaattacacagaataaaagtgtgacaaagatcttgtcaaaaaaaaaaagtgtgacaaagatatattttttagaataaataaatttttctgccaattagcccagtagttaaataaatgattttttcttgtttatatatatacacacataattggaggaaagattcatgagattgatttgtattgttttttggtaagcagatgatgaagcagacctatgctgagagcttgcctgtgttgatgccaggagatgagatcccaaaattcatagccatggcatgtccatgtaaacctccaacagatgaaagtatcacaatccatgtgcacaaggaagaaacaaatgattttcacagtgaaaatccatgttaaagaggtgttgattactttaaggtaatttagatatcgatcagactcgtttaaagtgaacaactcgctttacaaagtaaagggagtaatatcagagttaattaatgattgatattgtccgcacatatataacaaaatcatgtgcggttaaaatatcgatcattgattttcttgtcttagataaatacacttttgatggaccttttcaatttgtggtgagtgagaatatctagtacaaggacccccattttattttttggtcagaatgggaagaaaatggttggaatattaaccatcttgtcttaatttgttatttgtttgtgcctcttttcctagtacaaggacacttttaccttctccttttaagtctaagaaaacatgattgatgccactatctgaatgtatcatcattccacagccttgtaatataatttgtatttcaattttttttaatttgacatggccttttgatttttcttctagtaacatatgaaattcgtgtataattttacatgtcacatactttagagatattcacaagtgaatttatgaccgcataactaagttttatgtattttatcgcaatataaaagttcgcagcgtaactacaattttaaagacaacatggcaaaacattcttcttacaaatccaaagaagtgtgaaatggaggcaagtgtttacaaattacataatcttttcatgtaataatatatctacgaaaaagaagtgattacaaattagataattcacaaaatgtacatgaaattttcaccaagtgataaaagaaatgaaagtattcataaggctgattatcttttcattcatgcaacaacctcttccattagattggacccctcgttttatgaccactatattgcacctcaaacacctaatttaatgataaaagaaagacaatttcttttctcatcctctacacctggtttgtattgtgaaatccaaaaaaatataggatgttgaagagtatttttaacgtgttttttccctcttttgaattatataatctaaaatgttgtagagcgcgtgagaaactagtatgatagaataagaaattgttgaaaagaaatataaatgatagtcagccaacaattttgggtgaaaaaaaaaagtctctaaaaaattaatttggttagtatattatatgacaaataaattacagatatttgcataccttaactatttgcataccttaactgattaccaaaaaggcttcaattactcttggtcataaattcaaattttaatctccacaaaattgattttatataaatattctgttaaaaacaatatttttaaaggtcactattttttttgctttaaacctcttaatatgttgaaccggcacaataggagttattgagaagacttttataaaacaaacttttgcagatattttgttctatgctttgtgatgacagtcagtcattcactattgtccaaatatcctatcttcaaagataggatatatttttcatacttcaacatatgaatctcttctgtgtcatggaggtataacctgtctatcatagctgcaaaacttgataaactttttagtagcacagtacaaatgagaagaaaaagaagagcataaatcatattttttttatatataaacaaaaatataaatgacagaaatcctaaataaaaacaaaatttccaaattgaaatgactcaatatttaggatgtataaaatattttgatgcccgagggagttgatttgatttgcataaaattaaataaacagaatataaatatagttttggaaaagaataagagagatgatatcagaatataaaaaatattaagaacaattgaattgaataaaaactagattgtcattcacaataaatagagtttcacaacaacatgtttcaattagagttatacagagtcatctcagacctaatccaaggaaattagctagacatgaataaagaaataaacaacgtagtaaagaaaataaaccgatagagttccgtcgttgccggtgttgctcttcaatctaattcaatcggtactgttgctctctatttccatgtgcttctcccttctctcgtgatgcgtgcggcccttttctttcttttccaaattgtgatttccgtatccgagaatgtgtatccttttttatgtgcctagcttccttttatataggtttgtaacctagtttctttctttctccccaagcatgttacgtttttctttcttttctttgattaaacataagcccatttaaatccattgcttcttgataccttctgttttgctctttttaaccatattttctcttgcgtttatttctttccttgtgccacatgtccttaaaatcgtgtcacgaaatagccatcatgacacgttttagccaatgttgagtgaacctcatcctgtgctctaaatcgtgacacgttttcaacaatcgtgacacaattttgctttcttcaaaatcttatatttttcttgttttctttgctgtttaaacttgcttgtgaactcaaaatatcatgaaaatgacactaaaaatagtgaatgactgactgtcatcactttgctcttccattcaataccaacaacaattttttaattaaattaagggttaaatatgtttttgtttctatgtcaacttttcattttaatttctctaaaaaaaatcaactttttagtccccccaaattttaccatcttcgcttttggttcctcctttaaagtaaactcatatgtagaatacatattttcaaatacaaatttgcagaaaaaaaaattataatactataagaatttctcccaaaaaattagaattttttaagaaaacatgaattaaatatgaatttttatattttttacggttaaaaaatcatgtttaatttacgctttgttaaaaaaataattggaaaagatttttagaatattctacacatttctgcatgatatcactaagaaatacaaaaattaacttaaaaatatagaccaaaactcgtgattaaatattttatagagacgcaaagttgaataattttttttgagggactaaaacaaaaagtttgtatatttgtaaggacaaaaaatatattttccccaccctattatttagaccaaaacttaaaaatataggattattcttagaaatatagaccaaaactagtgattaaaaattaacaattattcttagacgatgaataggactattattttccccaccctatgctattctcgcgcgccttccaaaaatgccactggttcggattatataatttgaagcaaattgttagcatttttcggattctaaaatccgaaatattagaaactccattttttgtgttgtatttaatgtcaaaggtctctgttgatcgtcgtagaatccccgcataagcggcaaagcaattgtaaggattctatgaacggtcaacaatgatcatgacaccctaaacactcctaaaaaactaaaaaaatgtttaagaaaaagtaagaaaagatgggaagtgaagaattaatgactttgttgaatatgcaaatctatttatagccttaaacctttcctagatcataactacagtcaaatgatacgtttttcatggcccaaccatccaaaaatgcattaaacacaccacaaatcgtccaaacatttggttaaacgccaccgtccaaataaactgagatgtttcagattatattagtcgaacctgtctaaatattttcggattatataattcgtacaacacaagaatgtgtttaggtttcatttttggtcggttttcacggcaaatgacatagtttttttttataaaaaaaggtacaaaaataattaaacagcttaaattaaaataagaaaataacataagtgatgaatcttcttggaaggtgttcgaagaggtgcttttgaacttgatcctgtttgcttgtcaactgacatatttcgatcaggaggtcaactggatcaagttcataagaaccttttcggaaaagatgaaagacaagatctcacgtcgtcgttcatgagcttcatccggctgaaccgcacactcccatctaggtcagtcgatggacatcgatactcaacatcgtccaccctccgcgtgtctctgtggttgagttggtggttgatttgatccagctgatccttcaacccagagaaggtgacatcagtgtgaatcctgaaaaaaaggggtggttttcccctgttgcagtaaattgcagctagcttggtattcagatcaatgacaaagttttccatggttttttttgtgtggtttactggtaacgaaaacagggacacctatttatagaactttctggacgtcgtgaaccaaagaaactattggtgccatgaggaccacaaaaaaagtcttgtcctgaactatttcggattatataatctgaaacatccctcaccttacataaaatacgaagtttctcttattttcactcattatttaagcatttcagattatataatttgaaaaccttcgatagggtttcatattatataatccgaaataagtcagagtattagacggtggtatgtaattcatgaaacataatttccacccattaccttataaatacccttcaaaccttcaccatttctcacatcatcatctcacaccctatcttcctcttccttctataataatatattttcatcgttggtctttcataaaaagatgctactttggaaattaatggattgtttgaaatgtcaatggggatggttcaaccccgtcctcccccccccccccccaaacatctttttctctgctactttggaaattaatggattgtttgaaaggtcaatggggatggtccaaccccctcctccccccacacccaaacttctttttctccttccccctctccatcagtttgcatcactggtttaagttagggttttttaatagactaacattaggtttgaatattttatgtaataagtttaaaaagctttgagctttattttattgaaaatgtattgatataataataaaatgagatttttgtatcattttgtccttttaattttgtttatatttccattttttatgattttggcatcaaaataatataaataaaccaaagtctaattaaaattttggtaaaagacattttagattatataatccgaatcaggggtatttcaaaataaaaaaataaaaaatagggggcatgagaaataagtagggtggaaaaagtaataattgatgaattggatggaaatttgttaggcggtccaatgaaaagttaattctaagcccaaaaaagtacaaagaaactaaatggcatttcttttctcacctcttttaattcttaaaaacttcactccgaatttatttagactattacttttcccatcctataacagtctcacgtaccctgtaaaattttcaataatgtccctttgcaggtcggatttcataattcggactatgcttatgtataatcagcaatcataatctctctcatttcaccaattttgaattttgcttttaaaaacaacaaaaaaagggtctattcatgtcaaataaaatcataaaaacacaaggatgagagttaggaagattaatattgtccttaaaacgaccatacatgttacaaacatgttcagaattggtgttgatgttgtctgcattagcaccatgaaaaaagggtctaaagtctaaacgatggaattttggattttgagggcggagtatcataagaagtcccttctaagggagtcttgatcttaaaaacacaaggatgaaagctacaaagattaatattgtccttaaaatgactatccatgttacaaacatgttcagaattcgtgctggtgatgtccggattacgtaatccgaactgcatcggtaccatgaaaaaatggtgtttagggagggtgttcggattttataatctgaaaaattcatttagcgcgccctattttttgagattttcggattacaaaatccgaattggtgaaaaactcattttttttcaccttataacaaaggaaaacattagttcggattttaaaatccgaaaatctcaaggacatttttggaagaaaaaaaatagggcgcgcgagaaatggataggaggttaaaaataatagtcatttatttatcctaatagataattctaaaatcacactctctaacatgtacccattctaatataaattttttattgattaaaattcacatgagttctaccaaatatatatgaaaccaacataatttagtaatttctttaaaaaaaaaaaaaaaacataatttattgacatgaagcagatcttacattttcagtccggatttatttatactaatagaaaacataattacaagttttctttcaacaaattattgttgacaaacctaatgttacatttctcagtcggttgaataacagttttagcctccaaattttttaaaaattgcgattttgactctctaagaaaaaaaattacaaaactatcccttaagttttgcatttgtgacagctttggcccctaaggccaattttgactcggtatacgctgacctgacaccctacgtgaggtgtcacgtgttatttatttttaccaaaaattgatcttgggggccaaaactgctacagttgcaaaacttaggggacggttttgtagtttttattcttaggggaccaaaatcacaatttcgtaaaaattaggggacgaaaactgttattaaaccattctcaggtaaacttgtatcttttagcttttaactatactaaacttgaacttgagatgaagttcaaaaatggtgtcattatattttgatgttgcaatctcaaaactcagtgttaaattccaaaattgatacttcatctagaaagaaatataaacaaaaagtacatgtcttccgttcaaatctgaacatacatatatatattttcttatgttttaaactaaagaatagtttccgcgattaagatgttgaaaatgcatttctcaactgatacaagttcctatgattccttacatatgataaagtttttaaaaataaatggactttttacacatacaaaatttaaaactagatatgtaaaaattctgaaaaaatgcatacacatttgagttttgaaattcaaaccaatataaagtcctaaatttttttactttggcgatgtgtctggattataaaatttggacaacccccatccatattttaatgttcggacatagataattttggtgttttaaaagtccttggagatagaaattcaatttaaccttatttggtcaaaggatcggttccgaccgtgattcacaacaatcatgtaattgtttgggaaatacacgagtgtctctatagaactttttaaagaattaaataatactatctccgtttctttttaattgtcactttttgacattttacacaaaccaagataatcaataattgttactatttttgatacaataagttatacttttactataatgaccttattcatttaacatctcatttcatatatatctcttttctcaataaatactaaggataatatttataaaataacatttaatgttgcatttaactttgaaagtgagagttaaataggaacaaaaattttctccaaaagagacacttaaaaaggaacggagggagtaagtttttaaaaaaataatttcctaatctataatgcttaaagaatacaaaagaggtactcgttaaaaagactctaatctttctttttttataataaaccgattttcaacgtctctttgcactgaaatcggctccatgatattaaaggcccactcttatagaccatgaaccatccgattttttcttttttattttcatattagggatgaaccatcatgatgttattatagattattattactagagtgtcctcgtgagtttaactcagttagtagggacaatgcataatatatgtaaaggtcgtgggttcaaacaccggacaccaccaaaaagattattatcactagagtgtgcatttttaccatcaagtgtggattccatagctctaaatattgatggctgtgttttcctcaaactaacttaggagattttgatggtcttattcgggattatacatgttcttttttgcatggtttcttcgagaaaattaatagaccttggactgtccatactgagattttgggtttatactatagtaggaagctgtgtcgggatatttgctttaagcaggtgttgtgtctatctgattcaactaatgttgacctcatctaaaaggatttgaatgtgcatcacaagtatagaaatttgatcacggctaagaacattcttcgtagagattggatggttagtttataacatactttgtctgaaggtaacattacgttgcagctgatttcctgactaaaaaagtaggttgcaggggtagtggaggaaatttcgccagtttggtaagacatttctaggtggttgggttgggatttagtgcctcactcgagtattttaggtagttttcttagttttgtggagttggaatttggtaagaaagttgctctaggtttaattttggtttggcttgctattgtgtgggttctagaaaactctcgtaatgatattatttttacgggagtgactgtggttgtcgagtttttagttgatcgggtcgagtatttcatttgattcttacatcttttttttttttggtacaaattcttaaatccttttttttttggtacaaattcttacatcctatttatcggcaaggtttgatatatcctcaactttttttttctttctatttctacaaacaattccattggaccacaatcaacagttgatttaaatcttgtagcctactatgtcattttcagttttactctattgtggtacatgacctagagtggagaagggcataaattgggaaatatttggtcaccctttccttatctgccccttgcaaagtttagaactcaataccatgtgaaaatagtaggtggggatccatatagggctagacatgtgatagtgtgggggcatatatggtaatgaaattatcaatttttgtgtataatacgaaggtggtggatgtggacatgaagaagggaatcttgccacctttgttattaaaataactaagagtaatgagtggattgatgaaattgttgataaactttgagtattgggttgagcatgccatgtttttctttgtcttaataataatcacaatgttcctctctttcatggatggtgtgtttctttttcccggccgtcagaaacaatcaaaggagaatggtataatactaatcaaagattgaaagaaacacaattgggaaatagagaagcataaattatacaagtatatggaaaacaccatgattacattgagtagtagtagcattttaataaagtagtgtagttcgaggttaccatagtcatttcagttattaatataggggacatgctaacaatttgttaggataaaaaaaaaaaagaagaaataattgacaagttttgtgaacataaaaatgtattttttttttaaagttttaatgtggttgaatacacaattttcaaaatattttttttctttaaactttttagcaaataagatatttgtcagcatttccgttggtataatactccttcattctttgtgatggttgaaagccaaaaagactatctttgtatttggtgaatatttgtggtggtcgagcccattgtcgtgtttaggcattgactaaccactttttgtaccttgtgtgaactgcttgttttgagtagcctttttgacacaccttatgctgaggagactgttatatcagtgttaatataattcattttttatcgttcaaaaaataattatactccttcattccttaattatccatgaatatatcaaaatttgatttagcttttttctttaagttttccaagtcatttaaacaatttcatttatcattatttcaattagataattgagtttttttatttaatatattcatatatttataaaaaaaatacaaataacaatttatagcataaatatatgcttaaaataataataccaaaattgtaattaagtcaactttttcttttaagaaatacaaataacaatttatcgcatagatatatgcttaaaatctgttccatacatgaattgaactccactttataagctgggcacttaaaatattttcattaaaaaaaaactctagtatttaatatactattatttttgtcttcacacaattgactggcatgttttattttatcgaaaataataatacattttaacacatagccatttttatttataaaaacaactttccttcaataataactttaaaattttaactttaattaattttttagaataaaacaatttttttccattatttatcatctcaattgacaatgagttaacttaactctaaattcaacttttattatcaacgctaagacatcttctttacattgataaattttgatgtcactctaaccttagtgagtggagagctatttcatttaaacttttgttataaaaaagaatttaaaattgcataaagtagtggtgtttttgttgaaacactttctttaaatcaaagtctataatattttaatgcaaggattcttagtttatgttactttgtgacaaatggaggattcttagtttttgtttcttcttttcctttcactttgtactctcaagtctcaagcaaaatctctaacctctctcttctcttccacttcctcttcactcttttgatcttgctgattcttcgggtaacattttttcaacttcaccttccaagttttgcttccatttttctctcttctatgttactaaaaaaactcatgaaactctccaacaaatttttttggaccaatccatcaacataagtatcaatttttgtgaaatgggtcatcaaagaatttatgaaagtttatatctttaggctaaaatggtggttggaaagtgatttagttaatagtttgtttcatgagttttgcatttaatttaactatgttatgtttttgttttagtactatgttgtgtttttcaatgttcttggtttaggaacaataacaaatgttgtttattctttgatgtgtttttcatgagttctacattacatatgttatgtttttgttttagtactatgttgtgtttttcaatgtttttggttaaggaacaatgacaaatgttgttcttttttttatagggtattgaaagattgaagctttttttcttgtttgaaactttgtattcattgtgatgtctctaccaaggctagggataggtgatgaggaaagtaaaagcaatgttactttgttggaaaaaagtttgcatttgaatggttcaaaaccaaaagagttcaactacatgggattaccatcctctaattgttcatcagtggatagttcagttccaaaaattcaatcttttaaagatgagaccaaaagtaatttgaatcttaaagctactgagcttagattgggacttccaggatcactttctcctgaaagagattcatcagatttttgtttgagaagttcaaagcagtttgatgaaaagcctctttttcctttgcaccctcaaaaagatgatcatctttttgaatcaaagcctgctgttttaggtaacaaaagagggttttctgatgccatgaatgttttttcagaggtaagtttttaattcaatcaaaagtgtatgatggttttaaactgcggttcaagctatgctgcgaacttttatattgcagtaaaatgctgtttgatgcaacccgctattaagttgcggactgcaatttagaactatatgatctatctactttttaataaaataatggaagattgtactaagtattaaagttccctccaaattgattatgcaggggaaattgaagcctagctccaaaatgcttgagaatgttgccgggcagaaagtgaaagccgatgaaatagcaacagttaagattggtcttgagagacctaatggtgttggtgaaagcaaaccaggtcttaatggttctgcaaataatggaaatagcactgctcctgctagcaagtaagtagggtggccggtggtgtgaattggcattagagtttaccgcaaggttttaaatttaggacatgttacgtttttttatattgcgaatcaaatgctgttgatgtcgcagctcagcctgaatcgcagttacttacaaacgcggcgacatcaaaagccatgatgtcgcagctcagattgctgtcaaataatggccgcgtttcaatttttgtgatttttgagagtcatagtcaaatgcagcttgaattgtgattgtatcacggtcatgccaccataaaaaatcatgatgtcgcggcccaggccgcggttgcaaacttattttaaaagcttggcttggcttaacaatggaaatgatctcggaataatgatcgatgaatcttgtggtgcagggcacaggttgttggttggcctccaataagatcatttaggaaaaattcattaacaactgcttcaaagaacactgaagaggttgatggaaaattgggatcaggaggtgcagtgtttgtgaaggttagcatggatggtgctccttatttaagaaaagtagacttgaagaattacactgcatattcagaactatcttcttctcttgagaagatgttcagctgtttcaccataggtaggtaggaataggttataggttaattttggaataaaagaaaaatagtctttcaacgatttgaggcaatttttgtgtctggatcaagttactgcttatgttgatgtgatttcaggtcaatgtgaatctcatggaaaccagatgctgaatgaaaccaagctgagggatctgcttcatgggtcagaatatgttattacttatgaggataaagatggtgattggatgcttgtcggtgatgttccctgggagtaagtttatatacttggttttctttcacgcgattaatgaagcatatacatggaaatgacactgacaccgtcgacattggtagtatttttagaaaataaaataattgaatgttaccacatgtgttggtgttgtgtcggacactaaacacacattcaatctacataaggataaatacacatcatcaacattctaggtagataagttttatacaaatgtttaatcatattttattatcttatcacagtgtaaacacatatttaaacattataatgtgatattagaaggtaatgaaatagttaaacttatgtgtaaaatttatttatacagtctgtttatgctgataaaaataatgagttcttttaaaataattacagaaataaaaattttgcagcattgtggttttagtttgaaataggtggtccatgtaagtatattaatagaaggtaagaaactgccatttttggcattattgaagactgtacaaaagcaataaaagtttgaatgataatggatataaaccatactgtactatttgtactgcattggtgacatgtgagtataatcagaacaatgtgacttcaaattaaaatggactaacaatttaagccaattcaaaacttagtgcttgtttactgtttagattagctggagttagacgaaataatagtgtggcacaataattttgacaaaagttacactttagagcttaaacaaaatcacagtgctgccatgattccaaattccaaacatgcagtcatacactacatgaatatgttacatggggcttagccgcttaggagtttgattatcctgttttcaattttgcgtttcatagtatttattgcttatttcgtaattaatccagttgcgaatttgatacgattttattgaaagggattaggaaatttcttagagagggtctatgtttatagacagttttactaaccttgtttacttcactttgattttatatctgcaccctgcaaactaattccaacacctaatatatctcaactctttgcaggatgtttattgatacatgcaggagactaagaatcatgaagagctctgatgccattggtttaggttagtattccattcatttaacaccatcaatctttatttttgataaaattttatttatattatactatatgttagcatttccaattcaagtacaaattatgtgttgtggtccattttgcagcccccagagcagttgaaaaaagtaaaagcaggaactaagcagtaagcagtatcaataatggtcacacacactctatctatctaactgtctatggtgtgaaaatgtttcagtttttttgtttttattattgtcacaatttatataatccctaagacattttagtgtgaaagattcttatatgtcctgttgtgaaggattagtgtgtgaaactgtgaaatattgcattatatatgtttgtggctttgtgtgttgttgaaaacaaaaaactgtttaacttaatatggaatgtaacttttacagtttctatgacactgtttttaacttttgttacatgtctatgtcattcacctgttgcatatagtagttaggtgttggcaagaactgacacaaaaaaggttgaattcccatagtttagagttggtataataatttttatgatcacatttttacccaaacagtggtccccaacttgtaaccattctgaatatggaacaagattctagtatgacactttgaaacgattaaaattaaaatagacgaattcatattttaggctcgatattttagattttacaaaaaaataaaaaaaattgcatattttatgatatgtttgatctaaattcaatgatcatcaatgtagggactgcgtcgaattttgttgtaaccatattattactacaaaatggaaaatggtcacaaataaaatggaaaaatccacgtaaattttatataatagtttatataatagtgagcgttgaaaagaaagtgttactagccgaagtcggaataaaaatgttgtgcttggtgatggtttgagtcatttgcattaaacaatagagatactgtgacagtgttggatacggttgtcgggttgtccagtagcatagcatgtgaagcactgattattgggtgcagtgcagtgcatggatcttcctgcttcattcaactgaacagaagtggcatcatcaacaatgctgagctttcattggctcttgtttttataatgaaacattgttttaagttctcgacatcaaaaaagttcttgcgtataaaagaacctacagattacaggctacatagccatccttttttagggttggtttatgccatatagacatgaatttaaattggacatggtgataagttataatctgagttttttattaatttaaactaagaaagatatacctaccattaaagatttggaagaaatattaatctgtattaaaattttagatggctggattttgtactttgacatctcctccagtctatgctacagtgaatgtccattttagtcctttatatttttttctcgcttcaatttacttttcgagaaaacgcacatttatactttttttcatctgtatatcctccttacataaccgtaaagataaataataccttgaagtgactgaggtttatttaaggagttaatctcttctaagttttaacattttttttcatacacattgattagatgtcgaacttaagataaaaataatagagactcagaatatgtaaaacttgtgttacatagtgataaaaggaatagactttatataagataataaatataagagcttagaagtgattatgtttttttaagctaaaaatttctcgtttcttattatgctaaatgtgtgtctattttcttatgcttgtttttttcacttggttgtctatgtgttattatctttggttgcccgtgtattcatggttcttgctcgatctgtgtataggtgatttttataatgtagtttcttatatttttttatgtgtataaatgatttttaaattgaaataaaggaaggttgtttcctttttctttttttttagggaaaaggaaggctgtttcttatattgttgtttccttgtcactgtatgcgtgtgtatgtgtgagcaaatataggaagaagggtactatatcaagggagagagacttttttttttttttgggaatttctatagaatttgcctattttttttacaagaaaaaaatgagatatatattaacacaacaaaaatgatcccctacacagggagtgctaagggaagccagcaatagttagtacaaaggcagcaaggtcaaaaggaaaggctggctgccacgaagtaacaaattaattacaaagaaatgccccttcctccccatagtgagtcttcaacaccctatatcacaacccatctttatcaaccaacatcctccaacaccatttacctagtaacgacaagttgaactccctcagcctcctgacaccttacccttcatcctcattacttcgacaaacagagtcctagttcacccaagatattttcctaaaatcctcacctcccaccagtcttgcaattcaaaacacgagatgcctccttcaaccacgagttagtgacattcacaccagttaagatgttattctgaaaattaacttctaaaccagaaacttctttgaataataataacatagctctcatcaatcagatattggcccaacttttgtccccaataattaaagtgtcatccgcaaattgtaagtgtaaaatgtgcactagagtggtcgtcccaaccgagtaaccgtgaaaagacctgtatcaaccaaggatctcattgaaacattcaaaccctccgttgctaaaagaaagagaaaggatgacagagggtcgccttgtcttaaacctctctccaattgaaattcatcagttgggcatccattcactaacaccgatgtcgttgctgaaccaatacattctagggttaaatatgtttttggtccctataaaattaggaccttttaagtttagtcaatacttaattttaatagttattttagtccctaaaatttttctacactcagtattagtcattcctcaattcaaatttgtttaatttatgtttaaactcttgagtttctacgtccagattttgttaattttatctttaacttttttcgtttaaaaaattcatatttaattagtttcatgttaaaaaaaagtaaattttagttaatgaacttttcatagtattctaaacttgtctcacaaaaatcgtacaaaaatttaagagtttaaggataattaaacaaactttgttgtaacattgactaaaattagaagtaatgtttttttgtagggactaaaaaatctattaaaattaagtaaggaataaatttagaaattcccaattttatagattaaaaacatatttaaccctacattttaagatccacttgcgtcataaaactgaaaatttcatatttttgataacatcatccaaataatccaagtccatggaatcaaaagcttttttaaaatctactttaaaaagcgacatctccttattgagtttccttacatcatcaaccatttcatttgcaatgaggattccgtctagaatttgtcttcccttaataaaagctgactgaacatgccataccacactcccaataacaaggtgcaaaatgagtaaagacttgaagtggtttgcaaaatgagtatagactgctgagcggatatgcggaacaccttcaacttgaaccccatttaccttgatcatggaaattgaaagcactaacaaagtcttgcgaattttaaaagtatttaaaaaagtctttaaaagacacatatttctttaaaaaagtcttgtgaattttaaaagcactaacaatattcataatagtgtgtcatcaacttaatttaaggtacaacaagaagtacgtgacacaagaaatgaaacgggaacaagaaacaacatcttctttggcatagtttggaagctctcggatccttcttcaatgatagactccaaccttggaaatttggaacaacattttttaggggttatgatgagagcagaagctacctcacggcaattttggatgcttctcatttccatcttccttggcatataattaatcaatagttgtttggattaaatatcttctgcgtgcaactgcatagactactcttttaaattaagtatgaacggaatggattacaaaactctccttcaaaagatttaatcacaagttgtaattaatcaaattagaaaggaaaaaaaggtttagaggaaagagcaaatggaactatatatttatatttggagagtcatcggttgatattagtgataactttttttcgttgaaagaatattagtgataacttgaaaatgtctctttttggattgaaatagatttcatagcaatcacaacaacaaagcattttatgatcatttgtaaaaggagagtgttaaccggtgaacatcgtaaaaatagcaaaataacgtgtacacgttacgttgacttaaagaaactttttttttttttggggtagaaagactcaagaaaaacgtctctactaactctcgatttgataatgaaactatactattaatccttttgaatcatgtactatcctccaatcacattattcccaatgcattgcattgatactgtataatacatgaaagaatagaaaagaaataataacaagaaaaattcatgtgactcaaattcttgaagggattataggaacattgtttagtaaataagcacttgcagcagcaactccacttccgagctggacagggtaacccacatctttgagtgtcatctccacaccagcaagacaacccaaaagttgcaactgcaaatatataacatatgaaataatcattttttttttatttttataaatgacaattttgtatattataaatttttaacattgtctaatcatttttttatttgtactttgatttgttaaattcatgtaatagtatagataacaacatcaacaatagttagtttaagctattatgattaaataaaagctaacctatgctactagataattgaataaattaatgtctctatctaaagaaaagccaaaaaaatgttttccttggactaatatccatgcaatatgtgacaatgatggatgtatgagaaataactagtttacctcatttagatggccaacatgtcctattctgaatactttcccagcaactttgttcaatccacctcctaagcttaaattgcatctcttccatgccctactaactatttcaccactgtcaatgttaggaggaccaacaatagcagtcacactggcactataccactcactcctccttttggcaacaattcttcaatccccatgcctctactacaagcctacatatagcatagaagacataggaaatacaataaattcaagtaatagaaataagaatttttcgagacgcgtaaaaattactttgactagttgatgtgggatgatttcaacatatctctcttacccagaactagacatctgaagtatggacaaatacctgactcaaatacaccgaattatgaattatctggttgctttggctaaacgcttgtgccttaaaatcacattttcaaatccttcctcaaaaaccaagtcaagggctgctcttagaccatagagcaactgaatggaaggagtgtatggccaataagttcccaagttgtagcatttcaagtaaccattccaatcaaagaaagatctaagtgatgtagcagattttgaagcctcaatggctttaggtcctgcacatacaattcccattcctgtagaaagagaaagagctttctgagagctagtcactaccacgtctacaccccattcatccatgcggaaatcaagagcaccaatggaagacacagcatcaacaataatgagtgatgggtgctggtacttgtctgagtaaaaaaaaaacataatgtgaggatagtcactttgtttaagagaagtaaaaaagtgaaattttttacaataataattaaaactacatgctagaaaactattgattggaaaagaatgatacatagttttagacaaaaaaaaaacttgtcctaagaaaacacattatgtcatacatgttttagacaaatcattgtgaagtcaaacaaatgtaatgagacccgaaatatagcatttgaaatcaattatgttacttcttatggcaatgcaattatgtgacacttcatgtgcacacgatcaacaaggtatcacaaatgcacatgatcaaccaggtatcacaatttatcaacgagataacacaaatacatgaaaaatttggaattttcaccaatgccaataatccaacggatttaaaacttctaaataagactattccaaaaaattcaaatatctctatagatataaacatacacaaagttatgatgatgacaaatatatataacttaataattgaataacagtcataattaaaacggattatcaccgaggatttttctcactttcgtcaagtcatttgtgaccatgttgttgtctcattatgaacaatacaaattgcttttatggtatgtgttttatctgaagcaagttttgattctagagcatcaagatcgacaccttgaccccattcactttctacaacatcaatcttaaagttgaggcatttttgttgttcaatccaaagcaaactgaattggccaattaaaaaatacactacgatccccaagagacaatgtatttgtcaatgcactctcccatgcaccgatacctgaaacaaaacaaatgaagagtcataacttaaattataagtgtcggacaacttgatctataaaattaacgaaatttcaatataattcatgaaattgaaagtttcaatcatactaacgtcttattgactcaagtcttattgactttgagtcggtcaataaaaattatccgaaatggtttaatgtggtaaagattttttgatcaatagtattaattttagaccaaattttcaatttagtaggatgtgtttaagtcatcaatgtaaaaaggtaaaagatctaatcaactagaaaacattctaatgactaaggaaatatattagactaatatcaactaaactataacaatgaattaatatataaacaatgaacaatttaacaagtccaattatacattaccggttgtggggatgagaaatgggattctagaagtagtcttgaaaattttcttcacatcatcaagtaaagtttttgtcaatgctgttattgctggagtacgatgattctcattgtttctgttcattgcacgaataacatattcacaggaatgttggtaggcccaggaacaaagagatggtttcttccaggtccataagcaaaatccatcttacttctatgcttcaaatctcaatcttcaagctatttcaattcaaccaaaatataaaatccatcaaaaataaatatttatcatattaattacaatgatccttgatatcattaattgccttataagaacaattttatgatttccaaaactaaaattctttcttggagaaactttccttgaaacctcagctcaaatttttacataataaaaattgtggctagtggtgtgtagcagctgacctaaaaagtgagatagggtagccatatgacaaatgacggtcaccaatatttgattttttttggacaaattacataaacaatattataagctataaataaacttgtatatttctcaacaaaaaaaaaacttacttttaatataaaattaaatttaacacttaaatctcgtgagacactcataaatcaaaatacctaagaacaaaagatagagaacaaatattaaaaaaccataaaacaagagaaaccataagatagaagagtgtgtttcttggtaggtaagaagagaaaaagagttgaaaaacgatagggtttacaaaatcctcaaaatgccttaaaaaaagttttaaaaacagagtcaatttaaaaatttcctactaaaatcaaatagcggcggccactattcgctacgccactatagcatccaaagcgtcggctatttgattacgcgctgcttggacgattagcattgcggtttatcgccattatgctacgcgtgaccgctatagcgttgctattggccgctattgactactacgcgtatgacatatcacaattttatgtgttacgtgggttcttcataaactctctttgagtctatatttcacataaaatcatctaccttgtttcacaaaaaactttgattcttaatttgttttgagggttcgtcgtattgaccctaatattgttataaaaaaaattggtacaaatattattttttttgacaataattagaattacctgcggttatgggatccgccagaaatgccctcagtgaaacgaaaatagctggaaaatccgcgagtattcctgcggattaatttccgcatgaaaacacgtaggaaaatagatagaatctagtaatgacatttaaggtggaaaagtttatactttctcgttcaaaatgccacagccggtacattgtctaggctggtcgcacatttattaggtcaaacatttatcgagacgtaaaagtaattaaaaagtagtggcctttttaatgctaatagtatagtattatttattataatgataattgtatttttttttttttgtctataagatcttttacttacggctcctaaaaagaaaattgacaccgaatatacttacgggatgggtgaacgctcacggtctcatacataaagggcataaatttttgtttaatataaatacttagatgttcatgagatctttttctttagtattatatgtcaaataattagagggtaacaattttttgtactcgtttgtctttttattttacacatttatagaatacaagaaaaatataatttaaaaaatagatgaaaataaataagagaataaacaaataattaattttgttgatattctgcatctaatttcacagtggtaaatatataatttataatttttctataaaataatagaaagttacagaatcttatgtgattatttatagaaaattaatttggttatttgaggcatagaaacataatacatatttttttttataaattgatgtgcctataaggatcacatcatgatatcattaaaagaaaagtggagtacaaaaaaaagggagggggacaaaaccaaactctctaaatattaggaaaatctatagaatggaaaacctagcctatttttaactaagtcttctctaatcaaaggtgcagaggaccaccattgaaagccacatagaaacataatacataaatgtaataagagttaaaactgagaatctatttgtatttctaacatatataacatttattttcacatgacatgcatgatctaaagagtcttatttaatactgaaaaatgagagagatatgtattttattggtggttcatgcatgtagttggtgttgttgtctgtgattgaattacatgattttaaaaattatatttaatatataaaaaatgagacacatatattttcgttggaagatgtactagttaaccgcgcttgtagtttatgattgtaataagctccaaagtcatgtttatttcatgatcataagagaaaatcatgtgtgtgtgatttatcgaatattcaaaaaaaataaattaaagttaattatatatttttatcatatttaatcaatacccaagtttttattcttagctagtcctcaagtttttaatgatgtacttctttgtattttgacattgattaataatgaaaaactataagctattttctcttcaaaaaaaaaaatcatttaatcaataccccaatgacactctttaacattttccataatactacctccgtttctttttaactatcgctttttgatattttacacaaaccaagacactcaataaatgttactttttcttatacaataatttatacttttactataataaccttagtcatttaatatcttatttcatatatttctctctccgcaataaataactaagggtaatgttggtaaaacaacatttattgttgcattgaactttgaaagtgacagttaaataaaaacaaaaaatttctccaaaagtgacacttaaaaaggaacggagggagtaattacttgaatgtgatccattcgagtctctttttccgtagtcaaaccctctttaggcttctcttcatgaaggaccattttctcttgatcaaatttgatattaaatttacaagagaaaaaactatgatcaatattatgacaatatacacaaaagagaggtattacaactcaaacaaattataaacaaaagagtggtatgttcgcatattcaatattaacaacaaaatcataacaactatttctaattttagcaaacaagggatttggttttcttaatctaagttaaaatcatgtaaaaactaagaagggattaattaatagtattattgactttactctgttggaacaaaatgtgtttagcaaaaataatccttaagagttttgatgataataaagtattaaaaattgtcaattggatatgctaatatttgttcaagtgtacaagactatagacaaaaatttgacatcctaaaatggtcttggaagaacaaataaagagcaaatacatcaacaaaaagggaagtttaaagcgtttgaagaaaactgctcctgaaatttgaagtgctcctgaagacaaagtgctcctgaagtgatgacgtcatcagaagcaagtttatcagaagctgtgaatcaccagaagctgcagttcatcaggagatacaacttaaagcttcaaaagctgtttcaaggattcaaactcgtctaagattgcagaagactaaaaaagtataacaacggctattttgaaaggcattggatgcttattcttcaaagagcgttgacatagtacgtttgtacgaagtgtacaaccactatctctactactctgtttttgtctctactataagacaagaaaaacagctctgcctgcaacaatgttccttcacattgggaacgcatttgaaattgatccttcataggacaataaccatatcaggcaaaggatcattggtgatttatcaaaagcttcaaacgactctttttgaatgtgctgacaattcaacgtctctttcacacctctatataaaggagtgaagactcagagtttcacaagaacaataccaaacattagttaagctaaaactctgttgaaattgttctccacttcaaagttcacttagaattcttatcaaagctcatatcttagaaattctagagtctttagagtctgtatctgatttgtattgtgaacaccactgattgtatatcaagtgttcaacttcaaacaattttctttgtaattctgtttgaattcagaagtctcttgcagttgtgcttgagcaatagaagtctcttgattgtgttcaggagcataggaagtctcttgcagttgtgcttgaacatttgaagtctcttactaagtttagtagtgagcatttgtaatcagatattacatagtgaactctccttggaagtgcaagggggacaggactgacttctggtttgtggaaggaacctgtataaattgcttgtgtctttcctctctctctctctctctctctctctctctcttatccgctgcaattagtctgaatatcacttcagaagtagaactctatatttttttgatctgtactttcagttaggagaaaaaaaagaaaaagccaacacaattcaacccccttcttgtgtttttcttaccttcatactcgtcttaatttgtccgaggttggttgtcaagtaaaataatgtcatgacatactttcggttttccaaattttttaggtagcaatctataccatagcaaagagaggacaatcatagactcgtcttaatgtttttgagttgatacatacatgtcttggtgttattattgatttacaaatacaatgaatttatttcagtaaaataaacttgaattttggtttattttgccgagttttgtttgataagttgatattgtagggattgttcgtgataagttttattaacaaatgctaccatattatatttgagatgttagttcatggtaaaagcttaacattataagaaattctattatgaaaagaggcaacacataattgtcttaagaacaatgatcaaacttttacgggagggtgtggttttaatgaagatatagatcatttgatttttagttgtaatttttttttggtagaatttggtgtttgattttaaattcgttaggttttgctacaacgaacgactcagagtactatgttggatcatcttgcgtgtttttggcgatcttgatggtttcttaaagtcggtctggttatcaatgaacatcttttatctttctactatttaggtaatttaaaaggaaataaatcgttgcatttttcagcaaaaggaggaacaattgcaaccattatgtggaagaaaaaaaaaaggtttaatcctattcattgattgtcttttatttcttagttggttcctcttcttgttttgctggtccttccttgacttgtgatgtaacttggtaagtattataaatcttatacatcttgtatgagaatgattttttttagtgtgtttaatatatttcattatgacttttttttaaaaacttaaaataataataaatcaggtatattaattactttggccaaaaaatgctaaatagaaagattttatttgaaaatatcgtaataaatgattgatatgtttttttttttagggaaaattccatgaatgccttttaataaatataattgtcttaattacattaatattctcccttgtttaccggccaaaccaaaaaaaataagaatactaatttacaaggccgttccataaatttttggaggctcggctctaatattaaaaatggcccctaataaaaataattaatgataatttaaataattgtaaattaagaataaacattattttgattttaatttgtttttgttgaatttttgttgttgatagatatgtggatttggcctaactattcaatttactctttacttttgtcaaataataagtgtttgatttagacttacataacaaaagaaaatattatcctacatcccaacaattatacgcatacccctgtaaatagttgaggccccataaattggaggctaggctcggctccctggagctccttgcacatgacaaggaacggccttgtaatttgcacgtcgtctaaaaacaaaaaaaatcagatgttaacttcttttttttgacaaatcagatgttaactattatgctctttctcctcaaattcagatgttaataaataaattaaagattatccattattattagcacaaaatccatagaataattttataatttgagatcagtctcagatttgataacattaaatatttattattataccctataaaaaaattataatttttttttactcaatgtgaacgtatcttacttttttttactaaatgtgaagaatatccttcattttttaataatcttatagcagtgattatttgaaaagcatgatgaagataccctcaatgtgaacgtttcttccttagggtatgtttgatttttttcttttcaacttgaacactttattagtatttttgcaatttgggcacacattatttcaatctgtatccttgcaacttatcaatttctttccttcctaggcttctattaacatagaagtcagtacacctattttggcttatttttatatcaattatgcttatgaacattaattgtcacgtgaaaggcttttccaactcagcactcaccattcaaaaagagttgtgttatctgaacattcatatatgtgacaatttttgtgacaaccaaaattttataaaggaaatgaggcagtgacacaaaaaccaaaacaatagagtgagaaagtaaaaagataatgtgagtataaaaaagaaagttgtcacaaaagttataaaaaatgattgttgaaatttcatttctcatcaaaaattaccatagatacaaacttgggggatttgaggagcttttgttgctattcaaatttgggtatttactatttaggtgtaaacaagttttagatgtttgtatttgcaactatgatacttttaatctatgcaccatagaatattagcttcaaaacagtatacaccatttagcaataactatgaaattggttttaaaacattataaagaatttcaaacttgatacaaatctaaagatttaatattattttttttggtggtggtggagaatttaatcttttaacagattttataacatactttttacgttaataatagataaacaagaatcgagagagaacaagagtgggagaattgcactcatgaccttatacgtttctgtttaaatttgcaaggttgatcaacaattaaataactaatgaacgactaatcgataaattcattaataaatatcaaaagaaataacattacatcaaatgattccttaaaaaaaaattacatcaaatgataaaaagttgaatactattactaacaaaaccctagaatatagaagtaattgccactttatttaaaagttaaaacaaaagtaagcaaatctttataattaattactaacaacaacctccacagccacctccacaaccacctccaccgcctccatgatcccctccaccatgatgccctccaccaccacctccagtacctccaccactatttacttgcccatgccctccaccacaacctccaccaccacctccacacccaccacctacgccgcctccatgatcccctccacacccaccacctccgccgcctccatgatcccctccaccatgatgccctccaccactatttacttgcccatgcccgccaccaccacctccagtacctccaccactatttacttgcccatgcccgccacaaccacctccagtacctccaccaccatttccatgcccgtgccctccaccaccatcgcaaccgcctgcttgatttccatttgaagaaatggacattgctccagcactcataataaacatgttatcattcttgggagcactaccactacgttttgtgaccttcgtagcttttgaaacatgttgagcaccatcattcttctttttcttgtcgcccttatcatcatcccatttcttcccttgtttggaactacaacttcccatgacgtaaaatttttatgagagaaaaaaatgatgtattgtgtgattctaataatcacgagatcaatggaagattcatagaaactacttagcatttgttttctatgaaataaattgcattgctatgatgctatgaaatattttgtgtgattttatttctgcatgctttttaagtggtagcgtggactattaactgaactatgttcacgatgacaataggtttccattaatcacctcctattcacttcttcaaaattaatcacgtcccacatttttctatcgaataaaaatgtttaatttggtcattgaattgtcaatttgttatcaatataatctcttattaaagtcccttaaaaaaaatctcttattaaagtcaattataaagtcatgaactatttgtataaaaaaaagttcctaaactattctcccatcgaaatatttagtctatcagttaacgaaattgtttaacaattaaattgatgtatttttcgtattttaattagttgattttaatagtttaaaactaatttggtgagagatgagaggataataaattagggatcaaataaacggtttattcttttcttttatatttgatcttaactcttcgtattgataatagggtcggtccaaaggtcaatgtgtcaaagttaacttttaagctttaaaattttggcccaaaacaagttaaataaaaaattaattttagttataaattaaaatttgctcaaaaaatgttataaatatatagtgatagattattattaaatgtttgcttagcttaattgtttaatttgtggacctcatattctctttgacccaagttcaaacttgatttatctttttacaggtttttgttatattttactttattttaaaatgctttgttataaaatttgttttaaggttctaaaaacattggtccggtcttgtaaagaaatatttatatccttcttacatttatttatatcagcaacattagttaagaatgtagcatccaaaaacaccaacaaaaccaatatcgtctcacaaagaaagaaactcaaactcattacattactcaagtggttagataaatgagtatccgtaattttgaatcgatcgaaactatccaaattattcacttcatgacacaaacaatttttgaacaaatttcatttacctttaaccgaagtcaaaattactattgcgttttactctaagaacaaaatagttaaaccaaagaaactcatcacaacctacaccaaaaaaaaaaagaaactccatcacaacattaacattaacaggggacaactcataggctatatatgaatcccaactacgtgatacgcgggtaagatacgttaacaaaaattttatacctaaaatttatatgtatgtaaaatacttgaaaaaaaaaaagtattgattattcttcattattatattaatataaaagtcacaattttttaaaaataatacatgtgattaaaataaaaaaaaatgtaaagttttcgtataaatcaagagaaacatcattataagcatcttaaaattgaattatatacatctctagtgaattttcataaaattatctcacttttttacccttcaacttttctaggacatcttgtcaaaaaaaataacttttctaagacacatatatgtgaagtatcttataagtatccttgtgtatctgtagagtatccgataaaatatttttaaaaaaattaaaaaaattaatttcgatacttcatgggtacgtatccgttagtatttgtggagtatcgcggtatctaatacatgtaagcctccgttttggagtatctgagcttcatagctcataggtagattttttttttccgatcctatatgccaaaaaaatccaaatctgatccctttcacttttattttccaaaatgacccactttctattttggtgatttttttttttgtcattttcctcattcccgccatttgaaacaacgggaatgaaccccctctctgacacatgtctgtgcgtgacagattctgcatgtttgaccactttttttttttaatttgtttttcattaccgccattttgaaatggagggattttttttgttgttgcaacatatgtatattaaaaacacaaataataataagtaaaaaatattaatgataatgttaataaatattaatttatttgaactcataatacataacgttattaactatcagttatttatgcttggacaatttttcctaatatgaccggtatgccgacacaacccacattgtctcggtgtcggagtcctctctaccacctcatcgtccatttcagtctttatgcgagtactattgggtcgacttttctttagtcttcgcatgtttggattatggcaaagctcaagaccgtcgtatggtggccaataactcttgtcatagactactttgaatgttgtgttgtagatgtagtaaacaacactcttgtttttgaacacaactggaataaggattgtataatcatggtgaaatgaagaacacgcgactatgacatgggaacaaggcaaatgtaaagcttgatattttccacaatcacaccatcccgcttgtaggtccaccttgaaagttctcattggccttccctatctatagttgacgcagactgagaaggaatacctttctcggtcaaactgttcgacatgatggatgttagacttaacaatgtcatccttaatcgcattctggcaatattcactgaacacatctccagaacctacccttgcaaatgcttttgagcctatcggcaaagagacatgtcagcctatagtaggttgattggactataggtgtaacaggtaggttttgtgttcccttaaacacagagttccaagactcaacgatgttgcttgtcatgtcgccccatcttcaaccctcgtcatatgcttgagtccgtttttcatgattgctttttagtcaacaattgaagactaacattcattattttaaacactttcgctggaggccctatctcaactttcattacaacaacaaagaagaaagccagatatggtctgcaaacacatatctcatatgttttcagatagtcgagagacatcagacagatagagtaaggcttcaatttggcttaccacaacatccacctgccttattagataatttgaaagatttccacaaaatttctttgacaaaagataaaattaaagactcgtggagagataagcatcatcgtcaagtccaatggtggaaccaacgtcatcagttagcattagacaatgttcggtataaccatgaggtttatccaaatcgtcaatattttgcatggtattgggaatttttcggagatcatttgtggctttctagagaagaattattgaaaaccccaaggcaagcatgtgcaagaattttaccaagattgtcgcgtgactatcatgcagcgccataaacctatatggtgtcaattgaaaatatttggtcaaatgcacctccaccccacaaccaattcattacaccttcacccacttactttgaccaaagctttaacccatcctccaattacaactacaaccaaacttaccaatcaccaccacaacccacaaaccaaatcttacaaaacacctcaatctcatatccaagctattctcaacaaagtcatcatggagaaagctcccgaacatcaaactattcatttgatgacatcaatccaactcagtacacctcacaaaccagttacccagactagtcacaatactcctcgttcaacctaccaacccctccatacattgtaaactatcccaaaacaaactacacacctcaatggccaaattcacaaactaataccatagaaagtctaacagcagggtttaacgacgatgacttcgttaatgaaatatggaccaactcagccccacaagtgaaaaatgaagtcactatggaaactaatgatgatactgaaattcctgatgaggatgtggaacaggaagagcacgaggaagaggaagagcaaaactaacgacccgtacgaactaaaaaagataaattatgtgctacgggaggttatagtttacattggcgtaaatggatgttgtggagaaagtagtttttgtttttatttctaacactatgaataaaataattagtgtttttaaattaataaataatatttatcatcattatccttataattaatacgcatatgttgcctaaaaaaaacaaaaaacgaaaaaaaataaccaatattcaatcccgccatttcaaatggcggtaatgaaaaaaaaattaaaagaaaaatgatcaaacctgcggaacctgtcacgcacagacatatgtcagagaaggggctcattcccgccgtttcgaaaggcaagaatgaggaaaacgacaaaaaaaaaaaaaaaaaaaaccaccaaaaatataaagtgggtcattttgaaaaataaaattgagaggggttcagattttggatttttttgggatatagggttagaagaaaaaaattctcataggtatagaatatttatgatgataaatacaaagctagccacaacttatatgatctcatgatcaacataatttagtttttattttctatctaatcgatgacttctatcaagaacaataatagattgattacgaattctactaacactaacgtaatgttgattccgctttcgtccccgacctctcattatgaaattatcaatttcgggtgatgtaagtagttatgtaaacctaaacttttttgtaaccaaattatttaatagataattcatttttttaaataatatattgatagaggatattttaaataattatttgattaaaattaaattacttattttaatcatgaaataattttattatatataatgatgagcaggactaggggtaaggttgtgataacaaatttttaggggcaaggttgtcataccaaaaagcaaaacctgaagccgctggagtctacaatttatctgtgttttaaaagtaatttttagtagcgactttattttgattttgatcatataagaaaagttgtaatggagcctctaatgatttccaaccctaatttgtttgattgctgcaaatgttttcaacccttaactattcctgtctttcaggtatgcattttcttttcatttttctttcatgaattattttcatatgtgaagagccaatatgtttcaagctctatattcattagtgtcggctaacagatacagacacggacacaaaacactatacgacgatacggctattaatttgagaaaatcgtataatttagtgtaattatgtgtgtggtgttgtgtggggcacgacacatgtccatcactgggactcgcctaatatgagtgtctgcttcgtagcacatgacacaccccatcatgctccaaattagacatgagcgtgaccccccgagtgacaaatgacccaataaatcttggatagactatgaaatttttgagaagaatatattgagaatgattacctttatgttggttatacttttgattacaaaacttgctaacaagccttacaatgaatctcttattttattctaacaaatggttcaaagtataatttgatgattttcttttatgttgcaatacctttcagtgtgataatggtcatattgtttgctctacctgctgtactaaacttaggaacaagtgtcatgagtgctcgttgcgcattagctcaaaacgttgtaaagccattgagaatatattgttatctattgaaatgccatgtccgaatgcaaaccatggttgcaaggagaaaataagttacactggaaataggaagcatgaagacgaatgcatctactttccatgttactgccctctttctggttgtgactttgctgcatcatcagaagtgttgtccaaccatttcagccataaacatggggattctcgaatcaaattttcttatggtcactccttcaatgtctctttgaagtctaatgatgaaaccattgttcttcaagaggaaactgagggcaaactatttattctcaataatagaaccacacttttgggaaatggagtcaatatttgctgcattggtcctaactcttctgagtccgagtatagttatgatatattggctaggtctcagatatgcaaactgactttacagtcttttgtgaagaacgtccaagaggttgctttagcaactccttcatcagagttgcttgtgattccatttggttcttccgaacctctcaagctagatatttgtataacccccatggtacctcctatctccttttctttgctttattattattttttttttccgattacatttttgttattttcttttctgttttgaatttatactatagcattttatctcaaattcatcagtttttgaaatgccaaaactaaggttgttagtgttttctatttttggattagttcttgaaatgtcagtctcaaattttcttttactgatttaatggtatttgtggtgcagatgcaaatctacgtggaagatctgattggaaagacaattcccctgagggttgagagttcagacacgatagtcgatgtgaagaagaagattcttgacaaggaagggatcccaatacacgagcaacgtctaatcaacgacggtaagcaactagaggacaatcttacccttgccagttacaacatccaagagaactcaaccatcctccttgtcctccgcctccatgggagctagctgaccagcacgccatatctccaattacttcatccgagcaaagcaggcaactttccacctcatcgtccaccgctgtcggcaacccttatcgtgaagacaatccaccctatatgtagagaagtcatgcattatttgataacatagagtctgacttttgcttttcttattaagattttgacttgttctttttcgattgccttgagctgtataatgagtttttttgactggagatgattttctgcaactgaagaaacctatttactgggaatcaagctgcttaattgttgtttctcactcttagatattttcttgatcctacatttcctgaaattttttgtaagcgtaatatctaaatataattaaaataatgtatgttatcaacatgagttgagtctagcggaagatgttagattcccacaagtgtgttgaaccaatttacttaattccgattgaaagaggcacacacattaaggctctatttacgagtttggaggccacaactcctctattttgtactatatacactaaagattcaacatgtcatgaatctaaatacataaccaaaaaaacaaacaaaggaaactttcatgtttcaatcaacatacaactgaatattacatgattctttctcaagcctttaagggtaaggattttcatcttccataagaaaataaatgagtgtaataatcaatgaaaatggtgtcatattaatctcactgtggtttttgctccaccttagctctaatcttctgctccaaaacagaaacctcagtttcaagactaaacattctgttcaaagcatgcatattctcaagtgtctcactcaaagtcctactatcactcccatcacatctcaaatgttgcattggaccatgaagcattttattcactatacctttacttagatcatccacagctttttgtgtcttcttatttatatcatcacccattttacctaaacatttctcaagctcagcaacccttaatctttcagcataagcccttaatttcttaatggttggaacagtttctaatgagtctctccaagcttcaaattgtcccgattcttcgccgatgatcacttgtgcttccattgcttttcttagcctatcctctttgttggcagccacaacctctttaagatcatcaacattgtaaaccttaacagactcaaggtcatcgacacatgaacctacgtttctcggaacagaaatatctacgaagaggcgttttcctcccatttcttcgcttgctaaaggaagttccttaacattttgtttaaaaatcaaaggattctctgatgcagtgctagtgaaaacaacatctgcttcaccaatacattcaagcatttccgaaagcggtttgtagattatctcaacatcatttatttcttcacggattgctgcgactctcccttcggttctattaacaactaccatctttttacacccttttgcaaccaaatgtttgatcacaagcttccccattttaccagctccaataacaagcattcttgcatttccatgtgaggcttgatcaggtaacttcatcaaggctaattcgactgcagccgagctaacagaaactgcaccagctgcaatgttggtctcggttcggacccttttaccgacggtgattgcgtgcttgaacaaaccactgatgtttctaccaaagccattaactccttgtcctgctttcacaacttgtttgacttgtgaaaggatttgaccttctcccattacaagagaatcaagacctgctgatacttcaaaaaggtgttgtgttgcatctttgttgtatagcaaaaatagatactttgaaagctctgatgcaggtataccacttgtctgcaaaacaagaaaataacagaaatatccaatatgtatcaatgcaacagaaaacaaaaacaaattgagtgtatgtttggattgacgatgtatatttggatttcggaaaaagctatagcttgtagcttcacacttgccgtggttccaacatgcactaattcttgcacgaactcggtattatcatgagattcaattaataaaaaactcactgaattaagcgctcatcatgtaactcctttcctttgtataaaataaagtcaaaatgtttttgtataagctataagttttttcatgagctcactcaaatagtctcactaatgtttatgtctacagataaacttaaacatgtcaaaccatacatatatgtagatattagctttcacaagaactgcgtatagagaaaaaagtgaacctacattggacatccattcggtgacttctttgacaccacggtgctgagaaagtgcgacaacatatatctccattcggttgcaggtgctcagaactgctgcttcttcaatatgattcagattacaaagctcaccaatggctctaggccattctgcttctggtatggcaagtttttcgcgcacatcgacgggtgtagtatgaatacttagccctataacgacaatactgctcctttcctttgtatatcctgttgaaagtcaatttcatgtgtttttttttttgttgtaattatgttatataattgaaatattcactaacttcgtcgatgattaatatctaccgaggaatataacataataaagtttgcatgttctattctaatctattttcaacataggtctaatactcttaatgaagaactatacagtccatatagggaaattatattctcaacaggaatttgacaacaatttatatggatataacaaggtgtcacaattcattaaccatccacgaacataactaatcatgattttaaacatcattaaccataactttcatgtgtttaattttgcatacatgatatccactaaccacaatttgagatcaaatgtacacctgaaaatcttggttaacgatgttcaaaatcattgttaattggcataactttatgattaattaattacgacacctaattatattcattaaccatccactaaacataattaaccatgtattcaatctgcattaaccaacaaattattataataaaaattgattttatatattttaatttgtaaccactaatcttaaccatataattgaaccattcattatttaactaaaaaaacattcaaagaggacttactatcagctgcagaagctttaagctgttgtagtgcagaaacagatttagcattatcactaggatcaatcaaaacatcagaagatgaagcgtcacaacgaattgagcctctactttgaacaaagctctttttattactaccaaaaaatgataaatgagtagtaacataagaggaagatgttgttgaagaagaagaacaacatttaaggaacaaaggttccaatttagcaccatagaaactagttgaaacagccattgtaattagtgtacttagacaataatagtaatatgttacttggaactaaaactatgtttatgtttatgtttgtgtatggttggtttggtttttggagtttttgtgtggaaatgaataatgaaatgatgtggcaaaagatgtggcgtatggaaagtttttggaattatttgagaatgtgtgatttctttgtgttctgattggttggtgagtacacgttttatccacactccttcaattctatcatcatccctctctgttccaatatgaatctcatgtttaataaaaaaattgtatatatatacttggtctcatattttactttgtttttagtactaagtttttctttatttttttatattttattttcaagtttgattttttattcttaggaatataccatatttcttcttaaaaaaaaggaatataccatattttattttaattattattttgttttaatattatcttttcatattaaagttggtgtttgtaatatcagtcatattatgtatagtccgtctcaaatatgaataaaagaatagagcgtcgtgttaggcaatcaaatctttatgatatgatgactatctaacttaaaaacttttgctgaatctatgatataaattatatatatatatatatatatatatatacacacacacacacacacacgcacacatacatacatataatatgtataaagaaaatagggggtttcggagagattttaggcagacttttttgttattccaattatacatttaaataaatttttatataataatattatattattacctattcgtgttattaaaaaagatataaaaactctataaaaaaatataaaaattattatatttgttatattattgctataattgaaaaatataaatatggtttgttgagtttgttacatttgaaagtcacaaatatgtatatcttttatgcaaattattggtgaatttggagttccttattacacccctaatttaattgttattttactttttttttttttttttttgacaaattgttattttacttgatggtctctcctcttgcaaataaaaagttttggtcttttttggagtgaaaataaaaagttttggtcttttttgggagtgaaagggtcaaatgtcatttaaaatattcaatacgaaaggtcacaaaataagtaaataaaaagtagtaaataaaacaatgatatttttgtggtgtacataccatattttgacattgacgtgagacatgacacaatttgaaaattacgtgatagtggcattcaatttgctaaaaattaacaaaatctgagagccatgcatgtttttaaagagagggaagatgataataaacaaaggggagcattgatatgtagcagggaaagttttccaggattactggataattcttagctgcaactttcattccaaaaagtgggcacactagagctacacgaaatggaatgtgtgattgttttatggggtaaagttaagtttactcaaaagtttctccgattagtaatcggattctaataagataacttttttattgaaaagataaaattttaaattttttatatgataaatgtacattttttaaaaaaattattttatatttagcaagagagggaggacaaatatgtgtggaagtttaacaacaagggtctgtatatggttaattcggcatatagatacgcaatggaaactcttatatgacaatgaagaattaagagtaccggatgagtggagcagaatatgatgtatgtgtgggtcgggtccagtggcggatcttgagttaagtttcagaaagaaaataatattataaattggtgtggtggtacaattgcttgattgtaagatgagtgacgccggttcaaatcccacctttaactgattgagagactgcacaactgctgcaacaccaacatattagttgtaatatcatgcctaatatgatatttatataaaagttgggaggtgcagtggcacctgtatgtcaaggagatccgcccatgtgtgtgccgcaacgtgttaaagtttttgtttggagaatgctcattggttggttacctacacgtatgaggcttcaagataagggcgttgactgttagggcaattgtccttattgtgaaaaccattacaaaaatgaatggcacatttttgttggatgtgagatagcgaagcaaatagggatggaagcaggattgtggaaaacaattgctagttttgttaacaccgcagctgattttgcaaacctgttcttttcaaatttctgcaggttatccagagatgtggtgacaaatatcatcatgatcctgtaatgtctatggcggagacgtaacgaaaaggtgtggcatgacgaggcgaaggagccacatatatctatttagttaatgcatgacaacttaagggaataactatctatctgagatcccaaaacaagttctgttgcagagtagcctgttacatacacgaattcgaaaaccaccaccaaagggttatgtgaagtgtaatgtggacgctgccattttctataatcaatggcgctttggtattggaatgtgtatttgagacatttggggacattttattaaagcgctgacgaaatggtttgaaggaagtccacctccaatggaagcagaagcaattgggttgaaggaaactataatttgacttggtgagttggggttatcaaaagtgtcaattgaactacattgcaagctagtggtagacgacattggtgatagctcggtgaatcagtccaaatttaacaatttattaagcatatgtaggtcactcttaaatcaacatccaaactttgagataaattttattaaaagaagacaagttaattatgttatccattgcttagcaaataatttaaccctccttaaaaaaaaaaaaaaaaatttaaccttaaaaaaagatataaccctaatttttataccaaatcaagggcttagatctctttattttcccaagtcatcaaatctcaacccttaatccccaaaataatccgaaacaccactgtgaggagctcaacgccgtcagcctcaccgtaatccgccgtgaaacttccccggagcccaacccgccaccgccatcttcttttccaccccttttggtaagtttcctcttccctttattctctctattgttccccttattttcttcccccaaaaccctaattctacagtacttgaattcggttctgcattcatgttaatttcaaggttatttgatttctcaatgagtactgttatttttctcaataagctatttactataagttcatatactataagctagcttatcagctttccgctattgctgcataaatgttgttaaggatgatgagctaatgatggaaacttaggtacttaatagttgttaataattggaaaatatactgcagaattggcaattcatattagtaaagtaagatatcaacggttaaggtcgtaatgaatttagtacagaacaatgataggtatcaatgttaaaatagtgattgcatagagtagtaactattgagtgtgccgatgatttgtgatgccatggaaagtaaaatctttatttgttataggatagttgttagaatataagaaaaactcttctaatatcaatgttagactctgaagcacaggtactcctaaattggtgaagtaactgtatcgtatcgggtacataccagtacagggtacatgtactgtagtcgtaccatacgtaccagacctacccatttttagttagttgattcacgttagtggatacaacgaaaaggtgcaggtcgttgaaatatagtagaagtcattttggttttttattgtatttcaattgtctctcttgcttttgatgaaaatagggaggccgtgaacaaaacaagtgaatctctgaagcatgacgatagaagtgtggttaagtacatggttaaaatatgaatagtattatactatttttattataattggatttttttttttcgcagcatgtttctacaacaacaatggtagagtaattcactgaaaaagatattttctttgatattttattttaatgtacctgtacctttgttttttaaaagtttctgtattctgtacctatgcatcacaatcaacgtttatcttgtactttttttaatcttatagcatctcatatgattagttttattttaaaatagcaaatattagtgattattttgttaatggggggaatttaactcatgacctctatgatcttgtatctcttattggcgggagttgaaccgcatgacctatatgatcttatactatctcttacgatcttagagtatcttgtgtccctataaaatggttagtgtttagtcttttcaatgagggaagtataaaattaacaggtagtcaatcccggatagtggcgtggagcggttgacctcaaaagtgggagaatgtctagtcggatggccgctatttgatcaatttttggacatattaaatgattaatactgttaacacatatctaatgtaaaattaacggaataactgaaaaatcacaaaatattcacagtgagcaatacaaagtcttaacaatgaaaaaagaaaaaaactgaaaggatttgagctttgatgggaaaataaaaagtagtggggaaataaagcaaaaagagaggaaaattacaaacagtgcttaagaaaagaataatacaaagaattttttaaacaggaacagggaaaatagaaaaccttgaataagtaggaagaagaaaaaataggaacggaggaaaactataggacttggaaaagaaaaacagagtatgcatcgaaaggaagcaggaaacagaataagaaaactggaaaaaacagaacctggtcgtgtggggattcagtggaagcttgggactgttggacagtgggcgtggagctgagccgaggtggtgtctttgtctgtcttgcagaaaacgataggaaagaagaaatgaaggaggaagatggttttcaatccgcatgacgaagaaagcagttatgcatttgcaaggaagaagaaagttggatttgcatgtgaaatacccctctaaagtctcaatttttagggaaaaatggaatttttgtaagaaccataactcttgcggagaagatgtgacgcaccgcagttttctgtttccgaaagtgcctgttgcagccaatggccaatctgctttgcaatgtcgagatcgcgccgctattgactacctagaattcatatcaattattagttaatgtgattgttaattccaatcccattaacaactaatatataaggcatgcttacacgtgactaattattctaagcatgtggtcaatgcatgccatgaatacttttttttgacgatgcatgctatgcatacataatagacatagttgatgatgaaacaaatggatatgatcgtattgattattaaaaagatatgggttggttatgctaattagattagtatataaatataaatagtatttaatattgttgtatgtttgggatttaatttttggtgagcacccttttggtctgtatccgtgactttgatgagagaatcaagatgtttgcgcatgagagaatcaagatgtgttcattagtttactgaaaggaacttcgctgcaaaaggaagactttcctaatgtagacatgtttgcgaatctaaattatttcgggaagcaaaaagccctgggcaggctaatatgtggttagattacctttttatttaattgattgtatatttgatgtttgaaatatgtcatgtttggtgactttttttgatcaacttcttaattgttggattgtgcgcgcgtgtatagctacatatataaaatcttgtcttttttctcttgattttttgttagcacattatgcctgatcattgccccacatatgcaggctcagaataataccgaaaattaaaaatatcaaacagaggtttggctcttgcttgtctacttccctgcaatagatgatatacgaatcttaaaatgtcaaaactatctctttgtgggttatgttgacgattctgatgatggtttcttctactgccctaagtgtaatgttcggtttgatggtgtttttgacaatgatgttgatgatgtgattgatgtctacatactcagattccgacgcaagaaatctgctgcaatcaaagccgaaccaaactctcaaccttgctctgaatatgatgcatggtccaaatttgttaataatctcttagaagatgaaactcaacagaatgatgatattcacataatagaacagaatattgatgggacaagtgtctcacatcccagtgattttggaagctctaaacataaaacctcaaaatactatcacaaccacaaccagataaggatgcggcacttgatggggttgcagatgatgattgagcttcaatgcaaagcactagtgaaggagtttaaggttactcctttaatatgtggcttggttggaccaatatggttgaggtttatctccaagactggtgtttttgatgatgaccgggcttatacagtaatgcacaactctgagatgcagaaagaaggtaattatatgaagcttcctcgtgtgcatttctacattcacatttacattacaatgtgttcccttttttgtttaatggtctgattctgaagaaatccaattatcaacatggtaggaaatctatttattatagtttttgattgttaaccaagtgtctagtatagtatttttcaccaccctgaagatgtttgactcattttcctcaagtataacttgtaatttgttgattttatttcttccttgttctcaggagaaccagaagattatactatacgtggcaaatacagagaagaaccccacaacatgtttggtcaacgatttgttatgatatggttaaggtatttgaagaacaggattccactagcttgtacaattgctgtttcatatctggcatgtcatattgctaggaagccatcctaccatcagacatgatgaagtggacactcgaagggaagcttccatatttttctgcctttgttgaacttgaaaggctcatgaaacatgaatcacttgcatgtcccatcagttcaagtgctatgttcaagccccagcgagctataccggtacaaaagctagaatcatttgctgcatcaattgctcattgcataggcttggagttacctcctgtgaactttcatgcaatgcaatagcatatcgttaccttaaaaaattatctcttcctgtcgaaaagattcttccttatgcatgccgtatttatgaatggttgatgcctcccgacttgtggttatcttttacaaaggattattttaggttacctactcatgtttgtgctgtatcaattctggtgatagctataaggattttgtataacataaatggttatggagaatgggagaaaagtttatcttgtaatgttggtgacaaagacaatggcgaaatggataccacttttgcctctcatgacgagcattttttggtaaaggttctgctaaagatccaataggatgtcaaaaacacaaaatggattctgctgtgcttctccaacaccttcatgcaatatatgaagagattgcagataaccacggtaaagttatttacttgcattattatcttgttgaacctatgttgtgagtttatttattttcttaactcgtctttttcacaaagagagaggacattaatgtttactaagagagagagagagaacataaatgcacaatgtttatagagagacattctcgttgctaattgctcattaatacatgaacttatcagtagtcaatatatgatgatcacaattttttttttttttttttttttttttttttaatatttgtgagcataacaagtatgaataggtatagctacatattttccctccgcctatatcaatatatattcttatactatgaatttgtctcaaaaaacatacaattttgtttctttagtaagatgtattggacgtgtataatgtctatatgacaattgtgtttttagttggtgagaagtgtcagagatgtatcttctaagtattggtggaagtattttaaaatcaatttaaactattatcatacattttgggtatgtatctggaagtatctgacccgtatcagtatcagatatgtgtcaaacattgatacacttcattttttaagtatgtagggtttataaaattttacagcagtcaaaatgattatctaacatcttgtatttttgcagagtattcgaaggacttacctacttatctcaaataccgtagagatgttgtctttgatggatcaaaagaacaatcttatgataattatgaggaacaaagaatgattgaaatcctaaggaatttttatcagaatgaaaaggtaattgaagacttggattaattgttccatggggatgcccaaacatttataattataatatcttggaactaccgtcaacttcgttctagtttttcttggggatgtgtcagtaatgaagttgcatcgcattggtgatttggatttatttttcattaatagtgaatcttgaaaagtaaattagctatatcatcatttccctgactaaatgacattaaacttcatgaaagatgacattaagaaaggaacatattacgtatgagataatttcctgaaaatataatgagaggcattttctttcttaacaagtgaggtgtctttaaatattgaacaaaatctgtttcgatgatgtttattatgaaaacttactaaacaatgacatcgtatttgtcctcttcggcatatatcgttgaaatatttcattttcacattctcttgataattatgtagttttcttttggtatactatgtaggtcttttaatgcgtgtacattcgccgtgtaatgtctagtttctaggaattccttttattatgaaatttttttccttttcataatcgcttgatatattataaagaaagcttatcataatcaattctcatttgaagatgcttttttatttcagaataccaccaaaccatcagaacatgcagggaaatccaatacttcttttaaccgattgaggttgacggatgaagggcacattaggaggacatctaagatgaaaaatgtaagaagagaatgtttcaatgatccctctcttgatgatggcacctgccgtgtagatgactttcctggaagtttgaataatgataattcctcgagacttcgccatatggtgaagactcagttttcaacaagaacggcggttcaggaaaagctgtagtcgatgaagccattacacaaatgaaattagacatggaggaaaacctattttgttatgtaccacctcgcgtcaagccgaagaaccttgattatgttcactatgtcagaaagaaggataaaggtgccatgacttacgttgctcatgctgattattacattttgcttcggacttgtgccagaattgcacaagttgacattaggattttgcaaattggtgttttgagacttgagaaaagacttgcttggctggagaaacgggttgatcaatgcttgcatttgaaaccttccagtatttcttgtcagttttgtagtgttaaaaccactaaaaatgtttcagcagatgtgccttaactatcaaatttgaatatatatatatttttttttttataaagtttaacttaaaagaaatagagttgaaccagaatataattcatttacctttttttttttataatttttttcttccaattattccgactattatactcctatataggtaattgctctttaggcacccaacaatcgctctcgagcatccaatgaatggtgatctgttgttcgatactttattgattagttaggaaattttttaaattggttcaactgatttaaaaagtgagccgaacggtagttaactactgtttgacttaaaaattatctcctatatattatatatggggctaaagaaggaacactctattgcttaaaaatttgtaaaaacacccatggttctaaagaaaaaaactctatcgaaagatacatttacaaaacttgagaaactcaggagaccactaaatcaatttccaaagatggaaaactaaaaagtaattattttgatttcacatatgcataaaaataatattatctgaagaatttaatttgtatataacatatcaatactgtaatttttacacatacatccaattaaattacatgttcaattgatatttatagaattattttaaaaactaacctaaaaatgacgtattagtatgattttattggatacatatgtaaaaaatatttacaccattaacacatagaaactagtttcttaccgtaattagttatagtatagttttgtcatcgaagtttaacttaaaattattgaaaaaaataattgaaatggttttattatattatatttatgcagggttaaaaatttggggtgattatccggaagtcctagttcaactgacaaaaatgccgaaattattaggccggatgctatgattgggattcgaacccccgatactttcacttatgtgtgtgagtttataatgactttgccatttcgtctatctaccaaaataaaataaaattttggcgtgactaatggccatgcacccacgtcataaaatttgatgtttgcgtaaaactgtttttaattatagttaaatttgattgatgtttgcaatttttcaagaagtatttcaacgccctagtggttgtacaggatggacaaagagatttaagattgtgtttggatgggggaatattttgagagaattcaaatactttgaggtgaattccattgtttcgataataatttaaagaatttttaaaatgatggaaatttatgaagtagtttgttcaagttaaatttagagaatttcaaatgacatctaaaagttaataatttcaaaattcttcattgttatattttttcaaattttgcattttagtcctcaaattatccaaaattttcaatttgaccccaataaattttttaaaattgcaaattgacccctcattttaaaaaaatatataatttggcccctcaaaatttttgaaatttacaaattaacccttaatttcaattttcaaatttggcccaaaaaattaaaatttataaaaattgcctaaaaatgatggcgatgaaattttttatttctccatccaaacaaaaatattgagaaatgaacgtaatttaattgaatcatttaaattgcctaggattctaaattccttaaaattttctaattacctcatccaaacacacttaaagtgtgtttggatgggggatgttttgagggaattcaaatactttgaggtgaattccattgtttggataataatttgaggaattttcaaaatgatggaaatttagaggatttcaaatgacacctaaaagttaagaatttcaaaatgctttattgttataatttttcaaagtttgcattctggtcctcaaattttccaaaattttcaatttggcctcaataaaattccaaaaaattgtaaattgacccctcaaaatttttgaaatttacaaattgacccttaatttcaattttcaattttggcccaaaaatatgacaatgaaattttttattattccatccaaacaaaagtattgagaaatgaaagtaatttaattgaatcatttaaattgccttgaattttaaattctttaaaaaaatttcaattacctcatccaaacacactctaagggtgtttccaaaatccatggattggtagacaacgtgaccctatcaaaatgttagggagcgccttacttgttgtgttggtctgttgggagactcggatggcaaatggctgaagggatacctgcggaagattgatgattgtgatgctcttcatgcggaaatgtgagccatttattttgaaatggatcttgctcgtaaaaagaaaatcatgcatctttatgttaaaagtgactctaaagtcttaattgacatgttgacatagaaaattaaagcaacactctcttttgaacactctctctaatactcactctcttattggtttaaattattgtgggtctacactttcaaaattgaacttacacaaagtggtgggacatactttgatttcatccaataaaaaagtgaatgctagagagagttttgaaaagtgactgttgctagcattcctcttcaagaaaaatatatccactttatgcttcgtattaaacaaatgttggagttgagttgaaatatttatctgtctcacactggtgtgaagacgtaagcgcatttggctagccaaatttagttactttcttaattctttcaatgttcattttctcgagtctttctcaaaggagcttcaaagtcttttttacgacatctttgagtttgcatgcctagaaatgtctatcaaactttgtagtgtttttttcttcttcttttgggcttttgccctctttgcacaaaaaatatatttatttctcttataaattatttaatcctatcattcaaatacatttttttgactaatcattctaatacacttgatttaatataatgttatttttatataatatgtcttacactagaatattgtttatcttggcttctaagacacctgttggactgtttaatacgcatgtagttggcaatatgaacatggtgttatattacttgaccatagcactatgtaagcatgcttccgtattactacttgtaatcatacactatacattatgcatgtaccatccctcaaaaaattatgcatgtaccacataattcagtccaaaatccaagtcaaataattatgcattatcttttttatatctattagagataaatttgtcaatagttagtttagatttagttggatatgttatctttttctcattttcatatgaaatcatttcatcataatcattacaatacattgttttagtgatttccttcttcttttctatggatgccatgtttcttaacattgattatcattcaaactttctttttgaggaattaccattcaaacttgaattgtgatttcatgcaacacaccaatatatagaatagaacgtggttagtatggtaacgattgtgcttacgtatcttccattgttatgggaacatttttatgatgcttaaattaaaacgggacaagacaagacttataaaccaattaaaaccatatgtcatattcttgactagggtttattcaattcaaccctaaatatgtagctttcacaatgtcactgttttcattagcgtttttgaacatataagcattaaaattttgactgatgagtgttcatatcattcatacatatagctgaaacttgaagttaactcctcatgaaaatttccatattgatcttataatttttaaaaccgacccactcactaaaaaggttgacatagagttgacctatactttctattagttaaatatctagtctttttttttttttttcttgttttgttttaattaaccttctagaatttctaggagaatgagtgtctttgataatctagagttttaaaaagttaatctatttagaatttgaatttaggtactttttaatcaattcgacattagcagaaactcattaaccatgtgaattcaatctcatttgattgattttattttgttttgcattgtactaattggtgtttagtactcgagttgggattaaggataaaatcatatactactagtaaaagttgaaataacaacaaaaactaaagataaaaacaataaaattgatcactagatttagcgtctccaagactctaacacttaacgatcaaattaaaagtgaattgtcttttaccatatctaaattttcgtcgttattagaactttttatagtaatctcttttaagtcacaatccaccacctaatttggtgggttaatttagtttcttaaaaaaaaaaaaaaaacacaatccaccacattcaacttaatattaattttataatcacacctttgttttgaataaaaatgcacataacatttttttattgacaaaatatatttttctatttttgataattttactttgaagtctcacatactttcaagtctcgatccctcgtcttaacataacattatttatagatatgtttttaattaaccgagttttttatccacgcttttttttctctctctctcccactattttttttaaggactctccctctaattgctaattaatccataaatcaataatcatgaacctctaaaaaaaaaataaaaaaaatcaataatcataaaaccatgtttatatatgctttgtaaaggtggcaaatctaatattccaagccagatagtcaaactaaccagaacaacgaatggaaataggtcaaatgtcatttattatttaaaaggtacacaaagtaggaaaaattcaaaccaaacactaatactttgaggcagtggcaaatattgaatggcatattcactttttgctttgtcttcaattaaaaaaaaagataccagcaacacaatcatatatgcatatgtttaacaaaatctcagcctccccacgttaattaaatttatataccagattcccatatatttcctcagtctatttaagtagaaatgtacatgtatataatcaaggttttgcttatatttaagataaatgagagtataagcaaaaataataaattgtacacagattaaatgagagtaaaatcacgtttttccttatatttaagatcaatttatggttagtaaaattttgtcttgtaggtaaagattggtacttggtagttgtaaggacaataatgcgtagaggttggagttgaaaccccagattccacacttctccacccttaaaaatgtgtaaatctagtagcttgacaaaaaaagatataattttatctaccaaactattctatatttagtttttacaagggaacttgttttatagacatggttacaaagaatatatatatatatatatatatatatatatatatatatatatatatatatatatattagaatgtactatattataaatgaatgttttgtcaagagcgtttaaatgaaatgattcaagtctatacaatttaaagagattgtggatttgaatccaacccaaaaaatgataaaccactaaaactcttgagggttttgccgcttactaaagtttttcctgatttgacaaattagcttctacaattatacgtacagaagatgcccgattcacatagaaaaatacataacatgacccactctatttttaccatgtatgaatggcatatagtggttcaagtgggggggctcatctatatacgtaggtgatcatgatcggttcctatgcacggcagctttgcattttatatttttgtaataataataataaatgaaaaatattatattctaaagcactttcttaatttgattatttctttttgcacattttctctctccatttttttatcaattatttggaacatatttctagaactgaaaatttaagggagacacaaacttgaagtaataccaaaaagatgctaaatgagctaaaatttaattctaaaagctattcaaaggaagagggtgcctaaacatgtttatataccaaaaaacacaagaatttgaacaatgtgaacttcaaacaaattctaagcaactttaacattcatcctctgttcctcacgcctagcctatagatcctaggtcaacttcccacatgcaactcctaactcggcgttgatgtcatgttaactagatttaaatctcatgcaaaaaataagcttaaaagatgatggtgtccaaacacatattcctaatctcaatagtcttgagctatataggtgagactttaaataacttcaaatagaatcattaatttggatgagagtttgtaataaaatttacttacagtctaataattagagaagtttgagaaatttacttacatctcccgcattttctatatcttctttctatctttctctttctttcttacatgcaccactgatctttcttacatatattatgtgattgagaaagggaaaaaaaaatgtacaatgtggaccaagacaaacactgccagatttgtttttctccaaatgtatactgcaaacgaatacttgaggataagttatcaattaagcttaattacacttttggtccttacattttgaccagttcaggaaaatggttctgcctctttcaaatcgaacaaaactgtcctaaactatcatgttttttgcagttttagtcctacctcctattttcaactccagaaacgcagagaagtgacaattttaggtagttttagacctaccacctatgctcaaccatgaaataaacaagaaataaagcatgtgggtacaatgaatctactatattcagcacactaaccaaaaacaccttaatttgaaacatatcttagaaattacagttttttggttagtgtgtttaataaagtggattccttgtacccacatgttttattccttgtttatttcatggttgagcatatgaggtaggtctaaaactatcatttctctgcggttctggagttgaaaataggaggtaggactaaaactgcaaaaaacagggacaattttgttcgatttgaaagaggcatgaccattttcgtgagctggtcaaaatatggagaccaaaagtgtaattaagcctatcaattattatgagtgaaccattttcattctttatgcaatttgaagctgaacttggtaggaaacatattttaggatagatattgcaccacatcacgttctaaggtattgtctgctttcaatcattgagtgaacactcacaattttaatctttatgaaagacgttttcttgagtggcaacgttctaacaaagccatattttatctcgattctcaagcattatgagacttacagttgtattgagaacatttttaatcttctatttatcttatataaatgataaatgaaaaaaaaaaaaacccgcttatatcttacaagatactgtactaaggactattgaaatgacaagctatgttccctacaaacaaaccatagcaatgcacaattattatcaaatataattgcaatattctccaattgctttttctatttttcatcccgtttaatggatgtggcagagatggatgaaaatggtccaacagcaccgtacccgtgcaattcaaattaaagtaaaaggcccacttttttggataaaataaaaaaccattacggcactgcttcttgcagttaggttgggtcatatatgctatactaaaagaagtacaataataccacacgattgacatcgatcattattcaaagttgaataagtatcataagctagattgactttaatgaaagagattagactttcacaatatactgagtcaatatttaaattctgataaggaaatgtggtcatatctgaaacgcgaaagtagaagagaataatgtaaaatttaaaaaaagttatatgaaggacgccaataatattatttaatttataaagttttgtcaattttattagaaattgtttgcacaacgtcagcatgtttgattttgtataacttaatttcaaatttttacagaagtaactttttgtcatataatgggttgcattattggagatggagaacacatgtgtttctgatgtgatcattagctggatggagagtgtttacggtttgagcttaggcatcttttttatttatgtgttaatagtagcgttacttttgcagagatgaggatgcaagtttggggggtagatgggcaaaggtgtcgttggagaaggtgtatgtttgcttcggagaaagagcagttgggctagcgtgtttctcgtttagatatttattttttgcaagattatgttgtggataaatgagtttggactcttaattctcttgatggttacttggtaaaggatggttataaaatcatcacacaaactgagcaacctcataatgatatttattcaaaattaatatggaacaaatttgtgtcttcgaaagtgttgttatttacttggaggcttttaaataaaaggattgacatcgatcattattcaaagttgaataaatatcataagggaggttgactttcatggaatagattagacttccacaacatactgagtcaatatctaaattctgacaaggaaatgtggtcgtatctgaaacgcgaaagtagaagagaaaaacgtgaaatctaaaaaaagttatatgaaggacaccaataatactatttaatttataaagttttgtcaattttattagaaattgtttgcacaacgtcagcatgtttgattttgaataacttaatttcaaattttacagaagtaatttttcgtcatataatgggttccattattggagatggagaaagcacgtgtttctgatgtgatcattagcaggatggagagtgtttacggtctgaatttagaaatctattatatttacgtgttaatagtagagttactgttgcagagatgaagatgcaagtttgggggggtagatgggcaaaggtggcgttggagaaggtgtatttttgcttcggagggagagcagttgggctagcgtgtttctcttttagttttttttttttttgcaagattaatttgtggataaatgagattgaactcttaactccggtgatggttacttgataaaggatggttatcaaatcatcacgcaaactgaacaacctcataatgatatatatttttttggagtgactaaaaaagtagtgtcaaaaaaatttgtccaataaaattaaagactatgtattatttcactcataaaacagttctagtagttttatttggtttggttttattagctcatgtccatttgtaatcctaacagttgctaaatgaaaccaaataattgctctaatagacatccttcatatgtaaactaaaattttgtgataattttggtgaggctctagccacacttaggcttagagtagattcacccatgccaacaaaagataatttacctcgtcgtgaagtattgcttgtgggttcgttgttgtgctctagagggtgcgataaggaggaataaattaatcatctttttcttggatgcgacttctttggtagtatttgacatcttgttttttgatggttgataatttacatggtttctccctctgatgttggcaagcacgctttgcaattcaatggctcacgtgtgttcagaaaggatatttgttattggtttcacgaaatctggttggcttgtatctagattatttgaaaggagcataatgatcatattttttgcaactaagaattaagcttcattgttggtggttgaagacacacaaatctaatgctttctccaactttcattcatagtggtctagtttgttggtttataatcctttgtaatgttttgctagctttgtgttttttgggtcagtttttcctgcttgcattacaaagaatgatttttaatttattatttttggcatcttcaacgaaaaaaccgtatgagtttcacggaataaactcaacatcaacttttacaaaaatattctttttattctgtaatatttgagtttgaattttactgaacaattcttcaaattttacgggagtaattttttattcttaatttttaaataactttttaattatttgtttactttattttaaacatacttttgtagggaagaacctgtatatatttatcaaatcaaaatgtcaataaagcaattatagtgaccatgtatactttctagaattacatgaatgacactattagatttttgaagggaaggtatagtgtgggagacttccctttatatgttttacatatacttatactggatagaatataaatagatatagattatatagataccattagcaaaacaagattatacaaagaccgtggttcaactgatagaaacaatgcatgatatatgtaaggttcgtggtttaaactccaaccaacacagatttaaggttcaaacctcggtcatcacataaaaaaaaaatatagatacctcaagcataacatttatgggtactagaatttatatatttaaatctataaagtgttatgcttgagattctatgctaacattcacttacatgtcgattttagaacatttagaccattctgaaattactgtaaaggtatcgataggtttgggtatgaacattggatcgagaatagaattctgcaaattttccaaaatagtcatgctcgttgaggcgagttagaacctcgccacggcgagctaagtcagtagtgaaacctgacttgcttactccaacgagctcttttatggtttgaaagtatacatctaaataatttagagtctaatcaaatactttttaaaaaacatttgatgggtagaagtttattcaaagatcttagctgatgcactcaccaataactcttcccctaccaatgagtttggagatcttataatccaatgtagaagtctcttatttgataaacctgactttacagtgtcgtatgttaggaggcaagcaaatagtgttgctcatagtattgctcgagcttcgctatctcatcctagcccccatatttttcatcatgtattgcctactttatactgtttaattatgaatgaaatgaattgattcagcttttgctaaaataaaaaaaaaaaacatttgatgtgtgaaaagaagcatctatttttttaattttttttagggtgagtggatatggacatattcacacagtttactaatagaatgataatgaacatcgtgttaataagtttccctcaaaataaaaataaaaaacacgtttatttatggggttaaataaaaccctagtctataaagtcctaactcgactcttttttttatgtgcgtaagtttttaatgattgttgttattccgtttatctataaaaaaaaaaaatcacgttaacacattataaatcgataaatgattttttctttttggtgttaattcttcgattctcaagagaaaatgaccctaatgtgttatagggaattatcagatgtgttattatattaggttgacaaagttgtcagttgatcttatgtcaagtaaaagagaaggaataaagtatactccctccggtcacatttataagcaaaaaataattttttagattcattgaataactaatgtatccggtcataattatagattaaatacattaattattcaatatatctaaaaagttattttttcttataaatgtgatcggatggagtgcatctttcggctttggagaagtaataataaatcaataacattaacatcaaaattgcaaacattcttcttgatgttttgacttatgtaaccgaaaaaaaaggacttggctttgccaattggggaacaagtcaacacatgttattgtataaatcatgcatgagaagtggccactctgcccacaaacttctccattcacacacacaatctttgaatatgaaaaagaagataaattgaagccttatggccactcactcacacttgtgtgtgacaagacatttagagggaaatgggaatggagcaggcagacatactatttactaaaattggaaaaatctctttgaaaatactttagagaattcattccaaagatgttcatgattccttgatatcttaatggtctcttattttgttgaatacttttgatatattttttgttgataccatattgggtgtcaaacttcccttctcattttgtggcacccttttattcaccttttttaattgtgcctttttttaaattaatgaaaaagtggaacttttgtatgaatagattatatggaattagatgatcattaacttaggaagtaaactaatgcaagacacatgtaatgtatttgattaaaccagtaagcattaaaggacttttttttagagatattcgattccaaccaaaataagcatgtcatgaaattgatgggtataactctctcttttccctttctcatttatgagccgtcactaaaatcataatttcttctccttcatccactaaagatgggtgatttaattttttttttttttttttactgaaaatcactcctttaactcttttttctctttcccttttattgaaataagtgattttcacatctatttcgttttttattttgtgatttcttcgtcttagtgcggcattgtttgtctttcttatttcgttcgggtatttgttcggttcagattgtcatatcaacttcgatccagtacggatccaatcaatgactttgtcgtcctccacgttgcagatccggagacatgggtattctggagacatgaatatagtcatatctgtaggtgtttgtactttgtcgttttttgctattaacatggatgttgtgagtttgttcgcaggttcatcctttttattttcagcgaatttacattgtatcgatgtactctatcaatttgaatgaatcataatcatatatttttgtaaaaaaaataaatgaaattaatggtacacctcaaaaaatatatatgaaattgatgggttgtttataaatgttgtaactttaccaaaaaaaaaaatgttgcaaataaactaagatgatttatatttattttttgttaaatactatagtggttagagttgtatttctaagatgataagtgtggaatctgaagtttgaattccaacatctatatataaaatgtaatgtccttatcaaccgaaacaaggtcatagaaatctaaaatgattaataatgttaattctcttgtgaataacaatctattcatgaaccacgattcacttttttcttcttcttttccttataattataatttctgttaataagatccaaatctaacatttccaaatccaacatcataatgaacaagactctacctaccacatgaattaccgtagatataccaccaaattatttggagaaatgatatttgtacaaccattttgtgacaatttttgtacaaccattttgtgacaatttttgtacaactttctctctcatattcacatgatgttcttatcatctctcttcccttttctctctccattgtttttgaccaataagaagagagaaaaacaaggttgtcactaaagttgtcactaaaattgtcatgaaattgatgtataaatatcattgctcaattatttgccctgaagttgaactacatatagttttagtacaccatcaccatacatgattatggatagagtgaataacgattcactctaatatctcaaaacatatatcgttctatctaaaaaaatgtcacacatctcacaatttactaagttgttaaagacacaataatacacataatacaagtgacatagtatcatacacatcttacgataatataattttatattttcattcatctaaaagatcaaaagataattgcgcatattttgactttaactcattccattagactcaatcctggttggtaattagtccgagtattttctttttttagggattgtcggagttttttttttccttctttcaaaactaatgaaatgtatgtaattatggttaatgtttagctaatattatatgtctcccaacttgaggtttaaatgtaacatctctagcttatcaacctatatatgtatcttgcatatatccatacaatccgattagagaaccaaaaatgttgtacacaaaccatgaaatctaggaaacgttgatgcataccacccattataatgacaattctgtaccacgagtgcatgaatatggagaaagatattatttgtacaagttgaaaactagaagataaggtgaaacaagaagtggtttcaattcaagcactatttattaatagagaggaaaatgacaaaacatagacttatatatatgtattctaccctataaaagtctaaagtgcaaataaaatggtccaaccatgtactacattttgttggagaaaattttcacatgaagaatcaaagaaatacaaaagtcacaactcataagccatagtactattttgtttgtgtgtttggtgatagatacgggtagcccctagaaaatagatgcatttagacacatttattaatcttagtcattgacttaaaattaatcgactcgtattacacatttacctaattattttcgaataatcttaacgattgatttgagatgtgacggtcaagattagtgcgtcacacatttaatgtgtggaatctaatttttttggtgaaaattttgaaaataaaaagaacaaaaagaaagaaattatgagggtggcctaatttggagggtaagtggcaatgcagagggcaccactccaattttgttgtcatatggaaagtagacaaaaggaaacagtagagggatttgtatcttaagttagaaacagggaccccttattcttccaatacccttctttctcttctcttgatattctcctttgccaattattgttatcattctttacctctgctggtgcctctctatgttggtgtgtgcatttatgtgtgtttggttgttttcaagcctattcctattttttaggaccgtttctttttccatcctatgagtttttcacgcgtcctatgcagtttggattataaaattcgaacggcataaatactccataaaaacctccaaaatacgttgaaatatttcagattttagaattcgaataaggtcgcgagaaactcataggatggaatttcttagtgaatttcttaagtcattccacattcaagaacatagagatacaattgaccgaatttcttagtgaattgtgttcattgtttgcattttttttttttatatctttattctttaaaacggggttgcatctcttaacattattataattaggatatttttaaaaaaaatgtgactgcattttagaccatgacattaatatttatctacattgcactttaaaacattgctcttaaggtggtgacgctattattggccatggaaatgattagcgatcactatgctgcatttgctaggtgatatcataaacgacaaattataagtttgtaggagtattgattatgattgtaaaaaaagagaaaaaaagtttgtattcattatgaaaattaaatgaggtaaaagattatagttatagatccaagtaaatagtcattttcgtctttaaatatgtaaggaataatcataatagtttcttaatgagttgaaattttaaaatagtctttaattgtgcattctgttagtcaaaatagtctcttaaggccgacaataactcttttcctatagagattaatacgacaataattaataactcttttcgtatatatgagttgatataaaagtattaacggaacattataacgtcaaagactcttttgactaacgtagtgcataaacaatgactattttgaattttagataccttgaggaagtattatgactactacttacgcattcaaagaggaaaatgaatatttacccttaaatatatatttagagatattgttataattttgttacattcaaaaactataatgatactcttgaattttatttttttggtcaaatatgatactggtgaatttatcaagaacaaatgactatttagtactttttccgtctcacaatatgtgttctcttttctagattttttgtcttaaattatttataccttttacaatatcaatacaacattattattttttttcactaacatatctttatttattgcatttcaacaatttataattatttcattaattataattaataatgatgttttaataaatgatattttgagacagatggagtaaaaaatatacacatgttttatataatttcaagagctttgtttattatagaacaaaaactgagaggagagagaacacaaagaagaataagatgctgagataatttatttacaaggggtatatatataaatataatggattgagaggttaattttccatttttaggtaatttggccttttatggaaagaatcaatatcaaatagagattcctcttgttgtcttccaaacattactgattttgcatgcaacaagtaaagtgatagatatttgagtttcttaatttttaaatatttgttaaggggttcgatttttggtcaatgtgtatgaaaaaacatatattaaaaaaattaatcccttaaatgagtttcaataactccgtagtcatgcagttgcgagcaaatgatatttggtttatctaaaaaaaaaagtacattcacatatttttttcactccctcaagggctattatttgtaataatacaacctaaagaaaccaagaaataaaaaaaagggagtgagatctattgtcctacaatacactccattaaaatgaaggtaaaaaatgattacaaaagaaagaaagaaaaaaactagtcaactaatcttcaatgcaattggtagtagtagatgttatgatcagtggatctgtttcaagtgaagatttcttggtaaacacatcatgagtgataacaatttcttcaagacaaccatgaacattattcttgttcacattaccttccataaatataggtaatttagcatcaacatcatcacttgtagttgaactttttgtgagttctttagctctttgaacttgcaaattccaatcagttctacaaagaacaaccaacataagcatagcacatgagccttgagctgcaagtaacccaatccacaaccctggaaatcccaatttagccacaaatcctagaaagattgcaactggcataccaacaaggtaaaaagatcctaaatttatattagctccaattgttggtcgtgcacttcccctaaggacaccacaaccggttgtttggggacaatttccgagctcgcaaagtccaacaattggtaacacaatagatgttaactcaaggatttctctgtcatttgtgaaaaactttccccattggtttctcatcaaagttgtgaatagcattgctccaagtcctaaaaccatagcaagaaaaagtgaaactatcattgaaattcttgctttttgtggcctatttgcacctaactcatttcctattcttgttgaaacaccaagactaagtgatgatggaaaaacataaaccaaagatgttgtttgaataagtattcccattgaagcaattgttgcttttggattaaccaaaagtccacacatcattatcatgaactcataccaccaccattcgagacaaaccgaaacgcaagttggaatcgctagcgaaagcaatgaggaccaccctttaatgcaatctaaacttggtgaaatccatgactttttataaacactagagaagtataaaaaagatgaaagtaaaataacaaggtttaaatttgtcaaaaccattgctattgacacccctgcaatccccatttggaaatgaaccactaagagaaaatttagagggatatgaagcaaaacagaaacagctgaacaatatgttaagggcaatgtgattccttgagtccttaaatagattctcaaagggtgaagaattgaaagtagaaaaagatcaggcactaaaaaaagtataaaactttgtgccattgatgaaatttctaagtcttgacctgaaaacaaaaggattcttttcatgttgatccaaatgaatgagatagggattgaagttgaaagaagaagaagaactgttctttgaagtgttaagccaagtatcttccattgttttgctccataagcttgtccacaaattggttccattcccatggctaaacctgatatcactgagtaaccagtgatatttgcaaagcctattgaaagtgaacctcctgctagttccatctctccaagatatccaaggaaaatcattgatatcatagctcttgaatataacaataaaccagttattgttgttggacctgatatttttcctatttctttgatttctgttatggcctgaaatgcataaagagaaatagttatattataaactcaataatattagtagaattaatttagtacccttttttcatgtcactcaagagatattaacttggtgtagtttatttaacttaattattactttttacttttttcaaggaaaatagaataaaaaaaaaaagtacttgtttttttggtatgttgattatgtggttctgttttgtttcattacctctttaagagtaggccatctatgaagttcatcttgaacatgatcatcatcaagggtagaattggaataaggatctttggtatgaggatttatgaggtgagtttttgttggagaaagaaatggtgaagttggtgaagatggctttggattgcacatggctaagtattgaaactcaaagtgttatgttaaagagattatatgtgaatggaaaagttagaaaaatgtaggattctctatggtgttaaagtcacaagataggttgtttgaaggagaattgaagggttggtgatagagttagaagatggtttgtttgatagagaattggaaggtttttgaatatgtggtgaagagaatgaatggaagtgggtttttatgcatgaaaaatgcttgaggaacttttgaaacgtgtcttgaatggaagcaaatgctcaaatttatagtgttaattttatataaagttaggataaccttttataagtttaaacaacatataatatattctacgagtttaaattagttttacactgatatctaacagaaaaactctattttaaaacgtagttataaaagtagggttcaatgataaagtagttgattttattgaacatcgatgtaaaactagtttataccgacgatatatattcgatgagtacaaatttttatttataagtttttatgaaacaaaagtcaaagaaagattaaacttgaacggaagaaatgctattggaggtgcatggtaaccgacctataaaacttttctcctcctatgaaagttagtggtcataatatatatcctatagttttgtatattataataatagcaagtaaaagaaatgaagcatttaggggaatggcatctaaaaatagtggataaaacgctttctttacttttaagttaggagagaaaaataagtcaaaagttgtcttcaaaacggtgaaactcaagaatctagataagaaagaatgaatgataatgaatttattcactttaatcatattttcaagccgtcaaaataacgacaagtttggtttgataatgatgccactaaatagttgctttaactagcttccttgttaatggtaatggataatcttttcaaacaccgtgttttaatttacctttaatggaaaaaagaaagaattttagaataaaatttggaatggcaagtggaagtgattaagaaaagttgttattaattacaattatgggtggtggtatatttttttaatatcactatcttatcatgtgctgtaacttaataaaaaaagtttaacttttcactaggtgttgactcgtagttatatagtatttgttaaataataagatagcataattgattaaacaatattttatttgacattaatcaacattattatataattattattattattatttctttttgtcaaaaaaaaatataattattatttcttctgtggcatggtccatggaactctttggacttttgaaaggacaagaatacaaactcatgtggttagtaattgtctttatatattaaaaaaattaataacactccaaatatataacatggtttgttttgtttttgaacattagtttcttgtttcttattttggacaaagaaaacatgtttggtttttgcctagccaaaccatgcatgttccattctttcccaactcatgtcatagaaacccattcctaatacaagtctttgttgtctgggttgatataaaggaacaattcaaaacctaaaacattccttcactacttggcttcttcactctaaaatggaaagttttcactaatatcttactttttagaccccacatttctttccctcttgctcatttttctctttatgttattgctagttgaatgttacatcacgtgcaggcaatttttggtcgaggcaccaatgatttaaatcatttaatgaatgcaaattaagccatactattagtatatcagaattgcaatttgattatttgaataatttcttggtgtcaacaatctctttaaattcatatttacctgacactaatgccaaccgcaagttggttgttaagtttgtgtttagtttatagttatagctaaggaattcggattgcgtgcaatctgcatccttaatccccaacattcactcaatccatacatttgtgattgaatttgaaagattcatatttcaaatttcaatttaccaaacactaataccaatgccaagttggttgttaagtttgtgtttagattatagttatagttaaggaatttggattgcgtgcagtttacatcctcaatcccttgcattcacatagtcggttcatttatgatcgttagattaaatttaaaagattcatatttcaacacaaattttgattttttttctttctaaaatttgaataccaaacttaaaaatttagaccgcatggtctcacttcaacggtcaccaatgtactgactgcatgaatctgattgccgactagccaatctgaattcctagctaagaggatattatatatttatataacacattttaaccagtttccctcttgttgaggttatcttgattgatataataatatccatccatataaaataggtgttattgtcatgaatgggaccaccagcggcgttactggctgtatatagaagagacagatggaaaataggaaacattggagagagaataactctcactcccaatcacaaccatttaatttgtatcaataaagtttgatgagtctgtgcactgcctgtgtagaagagcattggaagggaacaaaccacctctgttcatttatcattatctcaaagacataagaaaaaagaaaagaaaaaaaaactcactctctataccaatcaatttcattttgttttttagtctaagagtataccagtacataattgaacttctctgaaatccatgataaatggagtcagattacacgtgtttttttgctcaaccagttattggaaatgaaaaagacaatcattttggatatcatgcagtcaaaaatgattgtaaggacaacttgaccacaaagtaaatggctaatgcattatgcataaatcacattttctctagttgtaatctcgaccgtacgttgaagatcagatcagatcagatcgctttgatgttaacctattttatgacttaaaacacttatcgtcctatctctatctaacgaggtttatcgaatacacttacaatttgttaaatgtatgatgcgaagacgcatgattttgcataaacggtgatgatttccgtggcagcgaggttgtcaagtttgttaactattgttaaagagtccaacatcagataagagatgacctgacaatgtgtttataagtgaaggcaatcctcatctcataagccggttttgtggggttgtgttaggcccaaccacgatttctaagaactacagacaattcgggtctgaaagataagcatgtggagcagaatcaatgctagtgaacttaataaagaagcagaagcagaaaatagcaaaacaaaacggttggtttaaaaatgaacatgaaatggaaacacatttggaatatggatagcatcttgatagggtaaagtgcagtgcctaattccctccaacctaaggaatttaatttaataacttgaaagagacacaagtctagtatcacatgattatggcataaaagtacactgtcatcaatcataaagacatcttaatacaagttggctaagtggagatcagacagaattttttgatacaatttgaactatagcacaagtttggtaaagactgacatgacaaatcacagattaattttgacattataaaagattatgcttctttataaggtcgaataaattctatgctattgactctgaaaccaaaacttttcactgtttatagatagatatgtgaatggttctgttacttctataggagtgagttcatgaatgggataactgttctgccaaatcacactaccattctattcctttctctcaacgaatcaaattactttgttttggcttaatggagatatcttgattacataacattattgaattattgttacaccacttggctccaaaagtaatacattagggagacatgtgctaagaattttatggaccaggaccagtaagcatattctgttcaccaaattaaatcatactagtacatcatgaaaaataaataaaaataactttcatatgaccttattaatcaattaccataccaatttacctattaatccaagttacaaggcaatgtacaaaaggcttgaaacgaactttcattaattgtgaagaatgttactatatttgattccttaatctgggaaccggttagcattttcctattacattttgggttttgttaatcagtgtccttggggcatcggttaaggaatccctaaatttttttttttttttttgaaaatgtaagtttttacttttgatgaattaataattacactactttttttataaaaacttacatgttttggttgcttaaccaataccccagggcaccggttaacattctacttactttttttgttttgcataggttcttttcattggaggtaatcttaattaagacgaatccagtattaaatgtgagcacctcttcatgccgaattcgaatcttggttcgtcatgttgtcacagtctaacctccagactctcttctggtagacccaacccactttggtacacattcatttttaatggagaagagagggaaacaaaggttagaatttaattaataaatttttagttaaaaggagaggacaagaagagttttaatggacaaaaaaggatcctttgtaggtttttattggaagagtcaaaattgagtgacaaattttactttcctccatttccccgtattttcctccaaaatattgaattaaacataacaaacttaaaataatcacttatttcctctccattttccaccaaccaaacatcaaattaaaattgtttaaaaagtaatgaagatttattgatatatgcattttaaatgattaattcaattagttctgtgtttttaataaacgatttgtatttcttgattccttaatcagtagtgtcttaacaaaagtattaaatacttgttttagggtattgattctaaggcactggctaacagaatccaatactttaacaaagagtgttaaatacttgaataatgccagttggacacttcatagcaagacccacaaattaggtgtaaacaaagaatgagtagcataaaccaaacctgtcattcaagatatctttatatcaaaacaaggaaaatacttgtgtaccaaataaggaggaagaaacagtaaagacaggtctcaatcaagctttacatcagcaaaatacaagcacattacacaaatgaatgagattctaaaccatcatgatagcactaatgcaaaatcagcattgtctagaaataaataaattttccatgtggaatgattcaaactcggcaataactcatcttggtgggaaaaggaggtgccaatattaactttggaacatatgcaagatgcccaacatacattcccgcggcatctagccttaatataacatccgacacaagactggtttacaattttttggattacatatgaaattccaagatatttggaaaaagaagagttgtatgaatttcttgtttttacattgttccgtagacatcaagaatatcattcccccttccttacagcccgtaaatgttgctcgtggttttacatagccaaccggccgttacattttaaacagacatctcaactcattggtatctaaacaaaatttgttacccgaagccttctttgcatcagaaaatagcaacactcaaaaataaggtcattggttttaataatgaccaataagataaaaacacagccaatatttcatttattcattagaaattgagtggaggttggaatcttgaggagaggaaaactcaagaataaggctacaaaacaataactatttacaaattcttgctacctgttcattttcatcattcctcttcaaaagaaataagtgccaaaagaaaacagcatatgatacctcatatgcggactcgaggcttttgtgtacgagttcggggaatagctaatagagccaagagtccactcaaaagggctgcaacagctgccacggcaaaggctggagagtttcctccaccaaataactgatcccacggtccacttcccagtgataccacaatctgtttaaaacatgataaatatgtaactcagtaactctcaaaaccaaaatcctgctcaaaattacactatttctacaaagttttccgatataaaacacaaacttcattaactttgaactatatacagtacctcggaataataaactacggtaactgactgatatatagacaaaactttgcttggggaattataaaacaggaatcatggtgatttcagaaccctttttgttagttgtgtggacgggcaaaaagctcaccctttttgtaaccagcattggtttactatttttattttaccccgcaatgactaggcaaagttgtcgcacagtctctgacaaatctcttcccatctttcggcattaacttggatcccatctttgagcagagcaagatgttgtgaacctgaatctcttgtccctattggtttttggtttcaacatttaacgttttcttctttgtactttcattttaatcttttaatttgaatatccattttacattttattctcagtttcataatttaatctcaatcaccgtttcacagagaggttgtgctccactttctttgttgtatttgtggatggttttatattatgtatgattgacctctaaaagaagagcaactaggagaataatgaattactcaagggataatatttttatttccaccttgaggacaagctgttttttccagggacgagtaattaaacaacagctccctggcaaacaaaatccgggaggaaaaaaagtgaaaagaaaatcaagttggaagatcctgtgacctgatcatccgcaaccatcctagtactacaaaacaagatgaaaagattaaagtgacaaatgtgcaagttcgccattagtaaggaaagatttttagttataggcgccttttttgcaaattcactcttgaatttaggccctatgtgtagatttgttttatttcaattaataccgcaacattataaacacccccgaataagattactaaagccaattttagtatgctttcttatgttgggatccagttcacaccatacagacactctagttggaaatactatatgttgagattcttgaatgtactattccaacaatttattttttattatttactctctgttgctgcacaaggttcctacttcctatcatcttctatatattgatatttcttctgtgttatcaattaagaaagaacaatttttattgtgttgcactgaaatattggaaggcaacaaaaaactgacaaagttaaaacaatttagtacacaaaattccagttatactgcatgtgtgagaatagttcttgggtatgactagttcttcgtttttggtatttttttcaaagtcctaattatcagttaataataataatttggtacagtttggatcacaaagaaatcggttcaattatttgttaaggtgttccccattcggttaggaaccacagaaccggtgtaccaaaccttcctatcatttcagttcaattttatcaaactgttgtgacagttcagttttcctaccagaggtgaaccatgaactgtcctagtcagcagtatgaagctgataagaaaaacaactacgtaagtaaattgtaatctccattctctaacacacaatttaatttttttcttttctttttgttattctttctctcaataccacaacatgaaaaatgctgaactggttatttattcaacaaaattccacgtgacctgaaagtcccattaattgcgacaaatgcactgtaagggatcacagtttacaacatcttactgcctcttgccagtcatgccatcaataggcatacattcaacctcgatgatttatgtaaattatactgttttatcaagtgatgtaaagctgagcgaatttgcatggcaacatattttaaattatacgagttgactgtgttaaaatggaaatctattaagattgtacttccactaggtttgtacaaacaacaaagtaatagtagttcaactttaaccatatatagaatagaaggaattcaaaagaaaaaatacctgcgggaccactattgccagattcaggacacccattgataaccctgtaagcaccaagaatccaaataattagtcttttagtcatatcttcaagaaagaataaacaaggcctttaatagaaacccaccttggccaagtcccaatggttcgatatgcgttgaaattaaggcatatggaacactataagtgatctgcaataaataaataacataagtcaaagttaagttaataaaatagactacatgatttcaactcattttccatttcaggcatatcatgttatactcagagaaatgtatcacaagaattgcacccaaaagtaagttaaagaagactagtaagtttgagctaaagagattatgcagccacgtacaagttagttatttaattaacataacacacatgtattggccactataattttaaaaaataattgaagaatagaatttaagattcagtttcaatggttataagagaaacttacagccattggaaacccaagaatggtaaagattgctaatgctgcgatcacaatgcctgttggcggtggttgacctttacttacgtagccaatgctatttgccgcataggttaatactaacattgcaataaaacaaatagccataaagatatttgagattccccacacaaaaccagcccctcgctttctgcacagcctttccatgagcaatgaggttactgcaagaacaactgaattaagcaataaaccaagtgctcccattctaaccccagtatcataaataaggcctccctctggatcaccaccataaatttcccgacccatccaatcagtatcaaagagattaaatgggaaccatccaatccatgtcagagcagttacagacagtactatccatacaggcattgaaaaatatttaaatgtcccaaacaattcccacatgaaagcttcttccgcactacccgactctcctgccccacttgaacttagaggcacttcatgagctgacacaatgctgagatatgttgttaccacgatgaaagcaacgtcgagaaagaacgcagacttgagatttgcacaactaatagagcaagcaggagtaagtgtgaaagtaaaaatcttgtaccagccactgtatgatccagttgcatacccaagaatgttaccaacagccataaacagggagaaataggcatttgcaacacgcgtccttcgagcatcattgcctaacatttataagaagaaaaagttaagaaaaggaaagaagaggggcatcagtgtctacatttaatgtgcttttatttgcgagggggtgaggtgttgacacaacacatgtaattcacacagaccatgaggaaatgagcatttcgtgtttacagcacatgatcgaattatttattcttgtcattttggttgcctttgcaaaccaaattaggaaaggtatgatgaaaagggcaacctggtccactaaagctcctgcatgcgcagggtctgggaatgggtcccaccattttgatgtattgtacgcagccctagcctgttttttacacaagaggatgtttccaagacttgaacccgtgacctttcagccacctgacaacaactttaccgttatcctttaaaaattcaaatttaattgagaactgtgttcgacggttaatatcaaagatcattcagaggacctctggtagcaatcaatgtagaactaatttatttttaattaagctggttaaatacctgctttttgaagaggagtacactttatcttgtatagatccccccccaccccaccacataatatatgtatctctacttgacaactcttacacatgcattccccaattcacgaatcacgacttccaactagggtgttagttagaatattccctcctaaaggtcaaccacacctccttcaattgtcgggtaaggtacccccacccttttggacctcttccacatcaacttcagtgactttggaccttgggtccgggtcaatttcccttcaaaattcacctcgtcccctaggtgaatgtgcatgaagaagccagtacaaggtgttcccttgggatcccattgctagaaacaaaagcaccaacttatgcacaagtatagccagttctacaaggatccaatgacttgtagtgtgctagctggaaactgcattcgttgatctcaaacattattttggagttaaccctcaactacactagcctcaacaaagcatttcttttggaaaatagcagaagcatcacgatggtgaggtaaagttgtatatggtctttaggtgttgtttctcttcataagtgaatgacatgtaacttcaagcactccaccaaggcctccttgctcaatgcagactgggtagtttataaaattccttaaaagtatagtttgtttgcatagctcccaatctagcctaccctactccatacccctaccccctccctttttacttatatatctctatatttcacaaatggcactagaatatccgcacctaattctgatcaggtgtacagtgcaccggacctccatgaatcaccaagtactccactcttttggaactcttcatcgacttcatttattttgggtctcgggtccaaatcacattgaatagaaaagaatttgtataatctatgtttttcatcacattggatatcgtgttggattcaacgtttctttaattatttcagatttcacaagacttatttttgtttcaggtgaaaatgatgaggataaatatagatagaggaaatagaatcattccaatggaatcacatgacgaactacaacaaaagagcatgatggtaccttaagtcagatatcgggtcaaacgtaaaaccctgctccatccaaggagagatcttatgtacggcctcacatactataagttgcctcccaaaaatctcatgctaaaattagacacggtgactaatcatgactattaagattcagcctaaatggaatctaagcagttgggccatatccaaataatctaaaaaaacctaccctagatgtaattggctgcagggcaatgcttaacaaatgtatatctatcaaatttagattttcaagagaccttcgaaacctaagaacggtataaacttaaaatggattctgatgcaaagaaaaagccggtgaaggaaaaatgaatttccaaaggctcttcaaaatcaatgattgcttggttaccatcccactcactctgatataaaccatacatatcaataattcataatttaacaaaataaaaattagtttggtcagaaacttaatgagacctaaaccctggtctacattaggcctacaaacaaatgaaataattaaccaagttaccacgctttctctctctcatccatgactaaagaaaattctctgaatcttatgaatcctttatgcaacacctactgaacaaagataactattcatgatgagggagaagcaaggttaaatgatttttttcatcttcctatggcatagtatacctttcatatataatccaacatattcattatttaaaaaggaaaaagaaaaagaaaattagagtaccatgacctcccaaaatagcaaactaaaccttccaacttatccggttcttctaaatcatggggtctccaaagaaagcaacagatgatagcaaaaacttaaagccaaaaattctttgcacaaaattttcaaaacagacactaccccgaatactcaacaaagagattgcaaattttaaactcatacatcctctggtcactattataagcaaaaatcaacattttggattcattcaattaattaatgattaaaatgatctttattatagaccacatacatcatttaatgaatcaatctaaaattttgatttttgcttataagatcgaagggtgtaaatattaacaacttaacgtagcataccataacctaacaaagaaaaatagaacaatttcaggcatataaattactattgactatataactgaaggctcaattcaaacatgaatcataactctctctctagaatagaaactggctgtacccactattctccaatgttgtcgatggctgaccatggcggaagccaaaaatcctacatagtggccgacatatggcgttgtcatccttcaccaaattggccatggcagaaagcctaaaatccgccatggccgatatttgagaacaccactaatataatatctataaaatcttatggaattttttttttttaaggaatgcaaaatatttttttttcgtctttcaattttacagacaagagtattaagtgtagctttcaataaactccctaactaaagtaaaagtcaacaaatcttacaacttagtccacaaaaataaaacaaatcttgctccaataaaatatactttttttgtcccaaattataagttatttggacaattttgttcaaattaaaaaatgtagttttttttttcctaagaaagttagaaaatgtagttaattttgtacggagaaaagaaattatgagttaaaaatagaagggttacatggtgctttaccccctgtaatataggtcattttttgtttttccccctgtaaaatatattttttttggaatacccccctaataggtcataaaaaaacgacaatattttacagagggtaaatcaaaaaaaatatattacagagggaaaaactaaaaatgacctatattacaggggtaaagcaccattaacccaaaatagaataataaaggtagagggtataatagaaagagaaaaaaaaacgttaatgtttaattacttataacttatatatataaattatataaatgtaaaatgagacaaaaaaaattctaggacaacatgtattgtggaccgagggagtgtctgaatgaaaaaacatagaatgcaaatgttagccgtatcctttgacacgtggcattttttagactattatttattttcctcaattatttcatttaaatttttgacatctttgtgtatatatatatatacacgtactaaacaagaattaaaatgtacctaccttatataaatctacgtaccaaacatgaactaaaaaagtacctacctaatatccaccaaaagcacgtaccaactaccaacttcccaaatcaaacaccaaattcactatttttagtaaataatgacaaacaaaaaaaaagtttagtaaactcaagtcaataatcaataactcttcatacaaggtaaaaatccaacaaattctatagtcatcaaaagtcaacaaattaaccaacacgtcacaaaaccaccctgtagttgttcgatctttcttgaatcaccaactttatcaagaatacatcatcatcatacaagtgaagtaaaataaaaaagattgaaattagagatgaagaagaattttgatacttacaagtaagatcagcgagtaaagctctacaaggaccttgagtaacattattagcaacatcaagaatccaaaacccgatcacaaaaacaactatagcaaaaggacgataattctgcgttatatcatcaccgatcaagtaaccaatatcagcagcatatccaattataacaacggcaaccacgatcgacgccgcgccgactaaaataaacggtctccgacgaccgaaccggctggagcatcggtcacttaaatgaccgactaatggttggacgaataaaccggagaccggtccacagagccagatgatgctcgcccatttatgagggataccgagttgttgaacgtaaggggttaagagagagagctgtaaagcccaaccgaattggataccgcttgctacggatgcgactcggaggagttggcgtaagggggttcgtggttggaccggttggaccggacgggatgtggatgtggatgtggatgatcgggttctggaccggtgggggtttgttgtagtgggattcggcatcgtgatgccgacgccgaatctggattggggaggtgtggtggaagaaatggggggtatgggtttttgtgtgagatggaagcaaaggtggtgtgatgtgagagatgaaggaaggaaagaatgaagttcagtgtgattgattctgtgagtttttgttgacggaattgaccttgtttaaggatttattaacggaattgtcctttggctagtggtaagagaaatgattgtagcaaaactaattttaacacgttttttttttttgttaaaaaaatttaacacgtttttgaaaattaaaaccagccaacttaatttgatttagctttttcaaaagttttgtttgcgagtttagaggagaaaaaaaaaaagaggattctcgaaaagaaagatggagtaagtttagcacgattttgttcattaaaaccaacaaacttttagcttgtttgtttatgtagcaaattggcaagagacttgcgtttaaagtagaagctattaattgtaacttcataattttcatgtttaaagtgaattggaaagtggaaatgagcttctataagctaatctaaatacacactttagctttatgtttttcgaaagttttacttgtgagtttcgaggagaatagaagagagaattttgaaacaagaaagatggagcaagtagaaagtgaaagttttgagagagaaggctttggagaatttagttttcttcatgattaaaaggaattcaaaaattatattaaagcaaaattttttaaaaggtttatatgaattcttgaagtttaatctatgttattataacattcttaaaattgaaaatatattacctttttgagtaatgaagaaaacataatattcttttaatgaaatctatcacctcattcgattttcaaccaaaatagacatagttgctaaccaaataaagtgagaaactttttctacatttttcactttcaaaagtgagttaaaaaataagacaactctctttattataagcactttttaatttactacaaagtttgagtttatctgaagattttatgagagttcaacccaaaacactaattcgattacattgttattctcgcgtccaaatattatttagccgtggattttgagaagctacatattgtagctttaggttgaacgtgcggtgacatcaactccattgaaaaaacaaacatagattaattcggatagtctcatgcataaagtaccacattgaaaacttaaatctatttgaaatgagattctaacattaacattatcgtaacgcactacactctattttccttcattatgattctatcgaattagattttccttctaataaagagtgtaaaatataatgtcatgttgatattcccttaaccattctactagtagtattttgtagtattattaagaaaaaaagtagtagtattttgtagtaacatagtaactcgtataagaagaattttatgtataaaaagttattggtattaggttgtgacttgtggggactgcgaggaaactcgaatacaagtttgattgtggcttatacgtaaaacgacaacagaattagatgagaacgagtttgttttaatattcgagtgtgtctttattataggtttgatagggaaaggtaacatatatagtgttgtcgcatataatgttattaaaacaaaaaggtgacgatgagttggcggccatggtcggctaactttttctgttcttttaaggttaattatgtaattaccttttgtttgaaaatctgctaatttatttaaagatttttataaccctcagacctgagtatgttacttcattcaatactgtctcattatacagttttatatactccaagtagaaatggtctcctagttatataagtatataactaaagtcctagtcattcctattgattgttttctgtgttttttattttttttaaaaattgggtattattttcacacaaccgcagagactaatctctagagtatattggaatctaaatggacgataagttcttcctaagagctttaacaatattgcatgtttaggtctgaattccatcctagaacattgattaagttaaaagagactcgtgcatatcatctaagcgttttgagttaattgttttatgtgtttgagattaattaatactaattacgtatgtgtgtattattatgtagacaatttttatttttttatttatattattttaaatcttggtccttctccttaggattagtcaacaatatttcaattttctctacattttatagtttttacaatcaattgagagttaaaattgtgagacaatgtttattttacaaaaataaaaatatagttgtattttgacggaagcatctaacatgaacctcaatttaaaggaatcatagatagcttgtctatcttttttttttctttctctgaaccattggcttttaagttgaagttattatattctggttcctattgtatcccaaacacatttagctcaaagtctagctgtaaatgatttcatctctcttgctaatcatgtcactttggtcttgtttgtgagtatggaggaaaaaggagggatgacttagaaaacaagtaatgagcaagtggagaaataaatgatattagaaggggatagttttagacggatcatttttcaacataatataaaatctccatcatttagatgaactcaaaaatagcattggaggaaattttttgaatgttttggcaagtttaaacctaaattaaaaatatattaatcataaacatattcatttattattttattttaaaattactctttttaaaaatgtgaaatatttctccattttttcatatatctcccaccctccaaaacctaaattaaaaatatattaatcataaacattaatttatcattctttaaaaaatcattctttcaaaaaatatgaaagattttttcatttttccgtatattctccaccctccaaaactctctcatcccctccaaactccccagcaaaaccttaaactcactttatggatgtttcttaccttcaaaaacaccatcatgattcttatattcaaaatcatggtgtcatatttatgtttagaaaagtatgttcagataacatttctcgtgtattttctaatacctttatttattggtaaagttcaagagaaaaagaaaaattaagaatctgaacgaaccctcctaaatatgcaattctcaaagatgtcatcaaggatgagactttaaagttctaaaggagaagtctctataactgaacatcaaaagaattattggataaactaaaattagtcaatcagtcagcacatttgtttccttcaagtttatgaattcaggaagaatgagaagaaacagtaacaacgaggttaacaaaattttccaatcaaaagatcagtcagaaaacttcacattaattcaacagtacagaatttttgctccaacaattattacaaaacaatgaatgaaaaagtgaacaaaataaagaaaattcttttatactcaactaaactctggaacctttccaagttctagctatttctttgaattgcaaccaccttacatggatctctagtaacctgtagcatacacaaaatgaatcaataatgttaatttcccatttttcaaatgtcactcaaatgattgtgaagtccacgcccaattaataatggaaccgcaaatataaagaccgcgcggctagacaccggaacttagatgatggaaacatgatgactttggatgctaatcatatatacctaaataaaatattttattaggtcgcaaacacatctagattccagaaagagaatgttacacagatctaaagcagagcaacgatttgttcatttgcaacgatttgttcattcactaagagggattaaagggaacggtctagcaaccgttctctgaacagctgaacgacgtctaaggccaacttgaaggatgttgagtttctgtagaagccgttagtaagtacaacgacggttgaagtaacgtttcagagtacaacgatggtggaggcagcatttgagaatacaaagatggtggaggtggcgtttgagggtacaacgatggtaaaaataatagtaaaactatgtccacatacacacatttaacaaaacttcactcaactgcttgcattgcattgcacattatataagaatacaacactattaattaggaaattatcatgcacaaactgatgtgtaaatgcaacactacaaagttgattccaagtggcttcattattgaacagttgcttaatttcaaatccctcatcttacaacatctccttaaaacttgacaaatacatttagatatgtgcttacaatggtccaaattaagcacctccaaattgtggaaaatggaagcaaaccttatgatattttcgtcccttaaccatgaattgtcacacaaattgagagactttaattgaggatgtagaccaaacttcgtcaaagaatcatagttttcttcactcttacccccaactgttggaaatttaggtcttaatataaacagatttcataatacatgttcaacaattatgaatcaatagcggaagcaaacaaaacattgaacatgattatgatcggatctacgacatgtttgatttattaaggatattaagaattagggtattatgaatacctggataaagctttcaaggcagccctctcatcaacaacgataaccaaagagaggagatgatctgaaacacacaatagagtcagcggtggctgatttgattcttcctcaaccggtacctttatgcctcacgttctcttcagatggggagaagagagagtttgccatgtacggtatattggggaccatagcctcttttatattggatggccattagggtttcccattattccgttaatgggccatccggacatccactcattgagtccatatcaactaattaaatatttaattaattatccaattagaaatctaacagccttattacttaatttgatcactaatcaactaaggcccacaattgataaatagctaatataattattgttacgatattttcccacataatgatattggaatataataaataataaaatattccaacaatctcccacttgggctacatatcttaataattatatcagaattctttaggcgcgcaactgaatgctatttatctttagatttcaactttacaatctggtccacctcatacattaataatgggaccaccgcggctgtcgtcactgacgtataacgtgacggaaccccggcgaccaccataccaatgcacttgatgacatagattgatatggatgagtgacatggaaatttcatgtaattgtgatctctgaatcatgcctatttccaactgatccaactaaagtctttaatgagatctaactgaagttttgcaaatttaaaatttgcacaaatgatacagaaatggttatagcaataataacctcatgaattttatttctgcagaaaatcataacataaagtctgtatcaatatcaaaacaaaagtatagaacataaaataagagactcccactaatccaagacatccttaatgacaacaaccacatgaaagaccttatgtgtcatgtctttgattagtggtatagctagcataaagtttgtctctatgtgttctatcatttaacaacaaaaggtaatgaaccttgtaaactttgttatcaaataaatatacaactgaattatgtcactatataactttagtggtctttcaatacctttaacaatatacaaccaagtgacataaatacttacagtaatttcctgagttggatgtgtattatatacaaacatccaaaagcaagagtctgacacactaatgatctccaaattatcagatttctaatgtgagtaataactctcttgttctctttaataatccttatggttgtcttttcaacaattcaaactttgaattgctcaagtatctgccaaacaatcttattatatacattattttcaaatgtgtataataaaatcatacataaaaaatcctataggcaaagtgtaggaaaatacttaaatttctgaattcataaattttctaatgggcaatattcgagactggaaagtctttctcggtggttgaggtcatccaaaaattatgtcatttcatttacaactttattaatataactcttttgtgatatccgaataataccttgagaagaatctctaagtattgaaatgtctaatacaaaagaggtgtccccaggatctttcatcactaacttttgttagagatttccttggtttcacataacaaacatatatcatcgttgactgaataaaataaaattaacatattaaactagaaatataaaattactcccactgaacttgctaaatccacaattctccataatattatctcaaaaccaaataaaataattacttaatgagaatttttggtaacacaaagagacaaatttcttaacttataagtggatttcatgactttgcaaaccatttactttgtatcaattgacacaaaagttttattcaaatgcaccatattgtatcgttaatgtcaccattaagaaacactatattgaaatccatcttatgcagctccaaaattataataagcaaactagtatcatgactgttctaatagagtctttcaatcaaactaaatagaatttctcttttcagtcaattcttaatgacattagaatctctaattcttgaaggtgttgagtttgatcaagatgaaatagtttcttaacttaattgagaggtagaacaataatgtcctcatgaagatccaaatatactataataaaagtaactatatgaattagtttagaactaattcttcctcattcaattttgttctattaccatatctctcccccaaactcaatatcctcaagaaaacttaacaatttatgtctcaaaatttccttaattttgtgggacgaaaatcttatagttttcaaaaccttaaacaatatagaatgtcacaagtcataactaaattgactctaataattgaacttaaaagacacattgaaatcatcgtttgaaaataaaactcaaaatatcttgatttcatcaaagagaaattaaaacaaaaaattaattcaaataatgattcactaaattgtcttttaaatacaaaaaaaaaaaaaaaatgctagtaacgacaatctaaaattggtttaaaaatgaataaagaaatctttatcgactttgtccattcttaattgacatatctttcaacatcattggacataagtcagtcaagattaccattcttcatttgcccttatcttttgaggtattttccgaatgagcactattttattttctcttgcttcagcctttcttatttgcacactttatgaattgatcatttaaacgatcatttctaactgtaacagttataaacttaattgtgcaaagataatacaaaatactgaattctcgaacaagtcatatgatagtcgaaattactgaattttcgaacaagtcatatgatagtcgaatttttagcgtcttagcaaagattaaatgtttacataatgtgctcctaacattttctttgcctaataaccttaacgaaatacccactctccaatgagagcttgtctttctctatattgcttttaaaaaacaccttagtttaagcaaagaaaatatgacaaaatttttgtcattctaaataacatctctaatacgtatgatattttggctttatgatcttacgtgacctaagagatttggtgtatattcacttgtcaaacttgattctcacattaggtgctgaatttgtgagagaatgtgagtttcaccacccttatctaaggtctagatccaagaacaatattaatattattctttaattcctaaaagaatttttaagagttaaaatttaacttaaattaacagatacataaactatattagtttaaagagaataagagaagcaaaagtactcaccaaaatacctagtgcatcatcaatatcaagtcttcaaacattaatatcaattgctagtggtagtttacaacaatgatcaaacattgacaatttactttgacaaagaataaattcttataattgtcatatgtttatcataatatatgtgaatgtaaactcttaaataattaaataagtttacactaacacaacatcaaacatgcttctttatttgtaaataaaagaccttaacaagataccaagcgcaccattaaaacacaatctttggattgctaagaattaactgcaagcggtactctcaatgtaatgatcaaacattggtgataagtcctgtcaaataatagtcacctttggacatcctattatccacatggataattacgttataatcaccacatatttaccatcacaggtatgtaactatccggccaagttgtgccttccttggggccgacgaaaactcgcataaataattacacactacatcttttgtaacttcagttgaatcgaatctacgcaacagaggttacttgggcaacattattgtttcaaccaactcaactgcagttactagataatcttaatatatattaaatgaggtgataaatcctgtcaaataatagtcacattcaggtatcctattattcacatggataattactttataatcaccatacatttactatcatatgtatgtaattatccggtcaagttgtgccttccttggggccgacgacaactcacatggataatttcatactacgtcttttgcaagttcagttgaatcaaatctacgcaacagaggttactttggtaacatgttgcttcaaccaaaacaaccgcaattactagacatttcacagcaaattaaatgggaatgatcttaaatttacaaagcactactgacataatgtaggctgaattagtccattatgttgctaagtaaccataaggtcactcgacaacccttaagtgtgaagacaaattcacgaatttgaaagaagatgaaagtcacaaatcacaccaatgtgtgtatgacaatactttaagtgtgaagacaaactcacgaatttaaatatatcgcataaaagcagcaacaaacatagcatgaaatatattcaaaatgcatgataagacaaaatattattgtagaaaacttaataacaataaactctaatatgataatcatgctataaccaaatattcaatttcaaataaaaaaaattgaatcttatatatacaaaaaaaaaaatattcatgccacaattgattcacatataccaattgattctttaaataaaacaatgaataactctaaactcaattatttcctaaataaggaaatatactttatgtttataaataaacaaacaaacaaagaaaactagagaatcaatattaatattttttcaatatttaaagaatcaaatccctgtcttatgtgtatatttgagatgcgtcattatacgcaaagaataaagacactaaattttctacaattatatataacagccaaatatatatactaatttatatgtgtcttgcttctcaaacataaaactttaagcacaaaatctacgtgaatcaaaattgaaggatatgataaaattatttgaaaaaataaaccaaaagtaaaataattgattctaactccttcaattttccaagcaaatcacacaaaaacaaaataaaatccaaatatgctcatatattttcaaaaggtcacacatgatccaaaatttgaaacgattttctttatgaaatccttgagtaagcagcaagtgtaaatataaaggatcatctcttttactggaccaaaaaaatggatgtagcacatatattattattcacacaaaaaaagtgtcaggatctaaaacttataaacacaatagtaatccccattgattatggccacaagaaaattttgattatcagaaacaaataaatctgatcaaacataagtatgtgaaccataaaatataaaacaagtgagccaaactttattttccttagctttctatacaaagttaaatattatcctcaatttaatcaaaaccaaatcagtggtattgaaaccgaataaatagaaaccaaaataaagcaactaaagttgattggtgaaagaaaaaaaaaatcaactaaaatcgattcgtgaaaagtaaaatttcacgctaattttggtgcacatccatcaacaaataagccatcaaaataaataaaaaacgtcatacactaaccatgatagcatgtaatacacacaagttaattcaaatataaaaacaacgatggatatacatgccttcaagaataaaatattaaccttttctcttaatattaatcaaatataaggccaataagttgcttgtaaaatcaatcggctgtaccataaagaatatctatcaatgatcaacaaaacaatagtagaccatgtggatgaagctttgaaataaaagcagaattatttcggcatcttacgacatcaaaataaagccgtaaaagaaaattttagggttcataagaaatagatgcagaaactaaatccaattatggacaaataaaaaaaaattggaattaatcccaataaatcaaacatgaagaccgctctgataccacttgttggaaatttaggtcttaatataaacagatttcataatacatgttcaacaattatgaatcaatagcggaagcaaacaaaacattgaacatgattatgatcggatctacgacatgtttgatttattaaggatattaagaattagggtattatgaatacctggataaagctttcaaggcagccctctcatcaacaacgataaccaaagagaggagatgatctgaaacacacaatagagtcagcggtggctgatttgattcttcctcaaccagtacctttatgcctcacgttctcttcagatggggagaagagagagtttgccatgtacggtatattggagaccatagcctcttttatattggatggccattagggtttcccattattccgttaatgggccatccggacatccactcattgagtccatatcaactaattaaatatttaattaattatccaattagaaatctaacagccttattacttaatttgatcactaatcaactaaggcccacaattgataaatagctaatataattattgttacgatattttcccacataatgatattggaatataataaataataaaatattccaacaccaacatgttccattgtgatctcaccaagtaaaggacagttcctagcgagtgcaaacaaagatgattctgttagcttatcacaattactaaggttgatggacatcaaatcaccaagaaacgaagacaactggataacatgttgatcattcagaaacttactaagtccaatatacaaatgtcggaaaccttgacgtcgacacttggataacaaacaaaagagtccgtcataactatagccccagcgattttttaggacaagctttatcaaaggaagacctccccttgcaatagtgtagagcaactcatcagaaatattaaaataatacaaaccaagacaagtcaaacccttgaaactcaccaatgagtcaataatatgtgaagtcatgaatggaggacgtgatattgaatacgatgataacgagaaagacatcaatgtcggtctctcacggagagcagaagcaatgcctgcatcggttaataattgcttataaccatcaatgttgacttcttggagaagcttacagttgctgaacaagtggaaaagtgattggttgttgatgggaaaggaagaaagattaaccttgcggagtttgtgaagtgaaagtgagagagcctctaccccattgttataactacgagttcgagtctctatcatagagatataatttaaggggtattttagtctgaggtcgaggtcgtcgagcaaagggaaacattctgcgataagaaataggttaacaaagccggaacaagtgaaagaggtcaaagttgtaatgttttgtgaaaaagctcgcaatccatttgctgggaagcggttaccaacgtttggaagtttgagtgaaatgattttgaatgacgggaaatctgagatttggcagagaaggtcgtcgaggttgttacctagatagcgagagagatcgaggaaattgagatgggtgaaccttttgaagaggctaagtaggaaagggggtgttggattgacgagagtgagtgagaatcggaggcgtccggtgatggagaggaaccgtttggatacggtggagagagaactcaagttgcgacggttgttgttttcgtccataccgtcgttgatgatgaatctgaagatacattcccaacatccattagatcatggctgcgttcacacaagttttgtgtttttgcatcacaaaggatttttgagtaatttgattcatttttccagcaatattcatgtgtttattagaagataaacactatcgggtaatcctagttttgtgaagctgccaccctctgtgaaatggctctctgccacgttagcggcgctatatcccactattggcaacataggattttatggtatatttaccattgtcattgaagctaaattcctataactaatatatgcaagttaatgcacgaggccttgttttagttatttttgaattcttgctgtttgtagcagaaaaattgcaattttatcgagttatgtatgaaactaaatccaataccaaactcaataatttctcgttgctgcttgtctattattcttgtattgtgctttctgtttcccaaatagtctttatttaagacattgttagttgtcatctaaacccttttctaataattttttcagccatttatgttttcttttgtcaatccctattcttatcatgttatagaactatcacaatgtgtagaattttttaatatattttattgtatatgtgtattgacagaaactgttattcatatcacattcttcagtgtcacatgttacttctcccttgacctaaataaagaaaatgcattgggcaatgatatgcgaataacaagcttcgcatgcttgataaggcaataaagatcattatatgctgcattttaaattttggattagatcaattctcatactttgtgttgcatctgaacaaatgtcaaacatgaaaatattaagaatcatgctcatactttagtgctgcaaaatgcactagcatgttggcatcttagcacagttaaatattaaaaattagttttaaaccaggttttgattaaggatgacaaaatggatagatgagaatttttgtaggattaacattaaattatggattatttttggaaattaaaactatataatttcgttaaatagaacaatttacaaatgtatcacttataaagtcacatgtgagaagctaaaactaatgtaagttagaattaaaggacttcgagttccttcattcacaatgtcacatatcacaaatttagttaaatccaatcaccgttgaccatcttaaattattcgtacaatgagaatcataaaccagatattaaagtggattaaagagtgtgttggtaccgctattgcctcagttcttgtgaatggatgtcctactgatgagttttctcttgaacggggtttacgccagggtgaccctttatctccttttttatttttattggcagcagaaggattgaatgttttgatgaaagcgttggtagacgcatgattgtttacggggtatagtgtggggcgcgcggatcatgtggttttgtcacatttacagtttgctgatgatacgcttcttattgagaataaaagttgggctaatgtgcgggcgctgagggctggtctcattttgtttgaagctatgtcgggattgaaagttaactttcataagagttctttggtaggggataatattactggttcgtggttgtcagaagcggcttccgtgttgggttgcaaagtaggtaaaatcccgtttctctatttggggctctcgattgggggcgatccgcgtcgattattgttttgggaacctgttgttaatcgtattaaaaatagattgtcaggttggcaaagtcggttcctttcttttggtggtcgtttgattcttcttaagtccgtcctgactgctctacctgtctatgcactttcctttttcaaagctccgtcaggtataatctcttccattgaatctttgtttaataaatttttttgaggagggggtgaggataaaagaaaaatttcttgaattaggtgggatactttgagtttgaggaagaagtatggagggttgggggttacgaggttgagagagtttaatttagcttgttgggtaaatggtgttggcggttgttattggagaaggaagctttgtggagaaaggtgttggtggctaggtatggtgtggcggatggaggtttggaggatgggggccggagttgttcttcatggtggagggagatagtgaggattagagatgggataggtgagggtggagagggttggtttgggtcttgtgttaggaggagggtgggagacggtgtagaaacagatttttggcgggattgttggtgtggagatgttcctttgtgtgaccgttttagtcgcctttatgacttgactgtgaacaatccaatctctgttaggaatatgttcttgttgggggtggatgtcggtggggaggcgttgaggtggcgtaggtggttgtgggcttgagaggaagagttggtagaggagtttagggctttattactaacagtttcattgcaggaatcaatgacagatagatggctttggttaccaactcaggatggtaggtactctgtacatggagcctatgacatgctgacatcacaggagcagcctcagttacatcaaaacatggagttaatttggcatacacaggttcctctcaaagtttctatccttgcttggcgacttctgagggatcggttacctacaaaaaataatttggcaaaccgtggcattttacctttggaggcgcagatgtgtgtttctggttgtgggaatgtagaagatgtcgatcatttgtttttgtcttgtgcaacttttagtgccttatggccaatggtgcgggcatggcttggagtggtaggggttgactctcaatcaacttcagatcattttgtgcaatttattaattatgctggttgttcgagagggcgacgttccttctttcatttgatttggctacttgttgtttcggtgttgtggaatgaacgaaatgataggatttttagaaatagacgaagttctttgccacaaatgctagataaagtgaaatcaacgtctttgtggtggttaaaggcttgtaatgttgtttttagttttggtactcatcagtggtggtcgagcccgctttcttgtttgggtattgactgattggatgtaattttgtttggaacttgacacttttgtgattgttttggcacaccttgtgcagtaacatttatggtgtcagtattaatatatctcattttcgcttgttaaaaaaaaaaaaaaaaaccagatattaaaatacaatacaagaaatgcataatagaggctcatgcaatcatatactttattcaacattttgctttagtctatatgtccttgtaaacgtttacgtgcatggaagttttttgaaattggcaatgaccctagaagcactatactctcaccaaatgataattgggttcatgaattactttattgaagcaaatagatgggtcatttggagggccttttcctttttatgttaatcaagacctttcttcaaaccttattaatactcgtgtgtcttttcttaatattctttctccctgagatagaatttgctacttcagaatttaattagattgggaccatatgcatgttaagaaaattgtatcaaccctattgatattttcgacttgttactaatgcaattgtacattttacaactttttgatagtacactacttttacatcaagttatcaattaataaaataagcaacacaggtattagtcatataataagataagcaaaacttactaactagaattaaaagctgtaaagataaagcaacaaaattttatgtgcaagaattacagcctagtctttttaaaggacatcccaaattttccatttcaatcatattatcaattcaggaactatgtcaccacattttttttacataatttatgtggaatttataaactaaaaacataaatacaacaataataataaaaataaataaaaacacagatttaaaagcagtattggacggtaaaatttaagatcaaaattctctttgtccccgtgagcataactcaattgacatggacatgcattgttatatgcatgggccggggttcgaaccccggacaccccacttattcactttgaaaatggtgaattctagccactaggctacttgacaaaaaaaaaaaaatcatttttaaactattggtcccattattttggcaaaattgtaatatttgtcttcttattttaattgcacgattttggtctccatttcactatctttactaatctatgattttgaccatctaatttaacgacgtgacaataaatcgttcgcttcaagtccctttgttgtgaatttggtcaaaatcataccaatgaattacaaagatgtatggagcaaaaaaggtagtaatcaatgagtaaagtagtctcaagcaacaacaacaacaacaaaaaaacagacataatctaagtgtaaaacagcaccacaaacataatcaaaatcaacaaagataagaaagcaagaatgaaacaaacagaccaagattgataactcaactcgatccaatagaacctcctataagagagagagcagctctccaatccactaagataaaagtgatataaatagattagaagaaattggattgtgaacatagagagattgaagcaattgtggttgtcattgaagggcttgaaaatggattggatttttttttatgcaccttattaatactcgtgtgtctttcattaatattctttctccctaaggttgaatttgctagttcataatttaattccattgggaccatatgcattttttttttgttgaaagaatttggaccatatgcatgataagggaattgtattaaccctattgacatttttccttccttcattttcttatgcatattcatcacaaaaaattaaagacaacaatcatattttcacaacttttttattgtacgttacttttacataaagttatcaatcaacactggtattagtcatataataagataagcaaaaattactaactagaactaaaagatggaatgatagtgcaacaaaaaagtagggccaagttttttaaaatacgtccccagattttccattcagtgcacaattcaggaattatgtcagcacatttttattacagtacttaattggaatttataaactaaaaacataactacaacaataataataaaagcacaattttaaacgatttgttcccccattgtgaaaaaaactgcaatattaacctcgtattttaattgaggaactttggtctccttttcacaatttttaatctaagcttaaatgtatttgtgatcccttaacttttaaaaaattgtgattttgagcctctaacaaaaaaaaataacaattttaccccttagttttacaaaacattataaaattgttaacaagacgccacgtgtcccaaaataggggtcaaaattgcagcttttcgtaaagataaagggccaacatgtcttatttccctaaagatagagaccaaaagagcatatttctctaaaatttgagggttgaaagagcatatttcttaagaggacacattttttttaggctaaagtgcacttttccacccgtaactttcaaaaacttgcaattttgaccccttaagtacaaaaactacaattttagccccctaagatttagcccctttgcaactttgatcctttttgtcaattttgaccggtcaatgtctatgtggcatgccacgtgtgtaattaatgaattaaaaaaacaaaaaaaaaccatataatcattttttaaatcaaattaataaaaaatgaaattaaaaaaataaaattaaaatccctcaatcttttatttcttcttcttcatcatctcttcctctcaaaacacccactgtcactctcctccgaccaccaccgccggtgacacctcctccttcttattcaacaatgcctctatcgcagccgtcatcctcctcctttttgtggtgtttcttttttctatccaatttggtttcttctgttggttttttattgtacctgcttttaaacttttgtttgtttttgtatcttttgtaagaaaaattgaaatttccataactcttattatcttaaatacaaaagatgaaaaaatgagagaagagaacaatgaaacatgcagcaccgctagctgtgtaagaatagtaatgtcgggaattgttggtgaaaaagtttgtgtgtggaattggaaatataacagtagatttggatgtattccagcctccatcatcacggccgcttacctccagtacatcagccaccatctccaacttgagaatcttcttcactcatgtttcaagatcttttttcatttattaattcatgagcttaatttcactacaacttacaaaacgtttgatcagttatatagtatatatcttcatgaaaatggactagaataaaaagaacaagaaagtgaagagtttgtagatgatatgtgttggtgatgaggatgaatggtgataatgaatattagaagatgatggatggtggtactggtgatgatgaatctggggaagatgatatgtgcctctccttcttcatctgcttgtattttttaattttttttcctgatttttttaatttaaaaaatgattatatgatttttaaaaaaattttaatttattaattacacacgtggcatgccacgtaggcattgaccggtcaaaattggcaaaaaggatcaaagttgcaaagggactaaatcttaggggaccaaaattgtagtttttgtacttagagggtcaaaattgcaagtttttaaaagttaggggggaaaaatgcactttaaccttttttttattagatggtcaaaatcgcaacgttggaaaaactgcatttaagcctttaatctacaattttgaccatttaacgacgaaacaataaattgatcattttgaaccccttatacttttgactatgtatcattgatcacaacttaatttaacactttatttttaaagacccacaacaattaggcccttctccctcgtgtcaattcttgtattgcaacattattaagttggacgatcaaaatcataatttggtcaaaaattaaaatagactaccaaaaattacctaattaaagataggagaatgaaattgcagtttggtcaaaataatattggcgaattgatcaacgatttatgctataagattttttttaagtgtgtttgtgctttgtccatacttaaaaaggattgtgtggatataacacacctcataaaaatattaacacacttagttttttttttaaggaatatattaacacacttagttagatgttgcaacaatgtaaatatattttgtttgcatcaaatatttcattgttattttggtctaatcatataagtaaccatgtcacttttggtctcacacgttttcaagttaatgctgcagtgtggggtgtgggctaatgatatgaacatataaagtctactttaaatcaacaatgttggcacttttctctccataattatgagtgttgattgatcatgcttaggttagcaatttaatgtctagttttaagacaactatcttttttttttttttttttttttacaaaaagaaaggatattcattcatttaaattgataaaatacatcaaagacaataacatgatcaatatcgctaaaaacgtatagggtgaatctgcgaacaaactcacagcacccaagttaatagcatacaacggaaaaatgtctacaaataatatgatgaaatctaaatcaccaaaatacccatgcttctggatctgcaacgttgacgcccaaatcattgattgaatttgtgattgtctgaagctaatctttcaatacgaaccaaacgaacaccacacaacaaatgatgcgaaatcaaacaacgccgcacaagacgacgaacaacacaacgtcgcactaagacgatgaaatcacgaaaaaacacgaaagaaaaacttgatgtatgtgaaaatcacttatttagattgaaagaaaggggaaaaaagatgcagaggtctaggtcaaaaattgacctaaaatcaccccacctcgatgagtgaaagaggaagaaaacttagagagaagaaagagtttctctcactaaaaaaatagggcagactattgtttccccgcttctctaagacaactatctttaacaatagaatttaaatatgtagtttgattgaggtgttataaaagacaaaaaaaaaaaaaaaaattatacaggttcttaggatttatttgttaagaaatttaaaataaaaataaaagttttgtgttgaaaaaaatattttgactatagagaaaaataagtgcaaatgaagtttttcctattttgactatagagaagaggaaacttttgtagggatttttcatttatttttcagcaatactcaattgccaacaaaagaacgaaagagccacgtgaaaacatgcatctattcatttagttgtctattattgtaacaaaacaaaaaaaattagttgtctattattattgccaataaaactatttatttttagtggaataacttattaaagaaactctatatacaatgtagagatctaattcgtggactaatccaatcatccactgaagggaggataattgaagtcagaacaaagtcatatacgaataagcttaacatgagaattattactgtatgaagaatatgaaccagaaacatgatgaggaacacactctttaattttaagtcgtacatcaccgaaacaaccttgagacaatattttgaatagatctttacgggcattcattagaattgtcacctcatcttttagtgacattgaatacattaaaattagtttctctcaaggtctgtaaaactaatttttcttgtaccatacttggttcgagcccagcattttgtgttttttaatagctttaaaactattgtagctactcatagctcacaattgggagttgggggatcttctcagtttcttaaaagaaatacaatgttctactgattaaataaaccagtctgagtctaaccttcatactacaatgaaccaatgtacttacaaaaatgtatagagatcaagcttttggtacacgaaaaaacctcatttgcctcaaaaacaactagttaacctagagaaataaaatataaatcatgatcatgaaagttttatccagatattcctaattcttaatatccttgataaatcaaacatgtcgtagtttcgatcataatcatgttcaatgttttaaggttaaccctttacacttttttagacttgataaactagtctcaaatagttagtacgttttgacagttctacttattactgattaactaagtcggtccaactcgactttgtatctataaactaacgtacctataaaatgtatagagatcatgcttttggtaataaagaaaaaacctatattcctcaaaagcatctagttaagctagcaaagatagcaaaaatgaaactaatagtggcttgtgacgcggcgaagcgtgttgtgtgaaaatccaaaagtcacgagaatccatcactaccctacctaagaacaccttacccaatctcactaacttagaaaaatacattttccaaaatcttataataaaaacgtaaaataatcatcaaaccgtagaagctatctctattttcgtccttttccttttttctttatattgagtgtgttttcttgcaaaattctaatcattgtagaatgataccaattacataaatgaaaccaaaagtaatataaccaacttatttcatatcaatgatgtggcatattttcaagggttgagatcggtttcaaatttagttttcgtgtcgtgtcgaatagccaagtgcaataacattaattgatttagttacaataacaacatcaaataaacatagttattttcaagaaatatgttatcaagtagcacgtgaacaaagcatggaaaactaaataattttggggcacgctacttattaaataaatcaatcactcatgaaacaagcatgactttgttatgcatcatgtatcacatttcttttttattttaaaataggtttttgcatcttttgcttgcttttcaagcccttcaacatctttgtgtatatatataaggcatgggttgttcaagcccttcaacatcttcattatctacgtgcattggtttaggggttgaataggaagaaacctcaacgcttgaggtttcttaaatttcctatagcaatccctaaatctttcgctatttttctcaaaacctaaggaagaacactaaggaagacatggatcctcatgatcatgatcgtttggcttttatttttggaatactaggtatttatttagccatttgaagaagaagaaaaaaaaaaccaagggttatcctcctccacttaattgtcatttaatttttttagtgagtaatcaaggatgtatgatgaaatatcatccttgatttattttttttacttaatattcaatcaatttagaggaggaaaattccaatatatcctacttctattgaatcaaccatcacactattttaatttctgaatatctatgagcaaatcaagaacttaacatattgtcctccttttgatgcttaggtaacatcatttcctccatggtgtacttggcacccctgtaagtatatgttaatttctttatcaatatggttttccttttcttatatatattattataaaactaaatatgtttttccttttctttatttttaggccaacattttaccgaatatggaaaaagaagtcgacggaaggattccaatcgttgccatacttggttgctctattcagctccatgttatggttatattatggtttcgtcaagaaacatgcttttctactcattaccattaattcagctgggtgtgtcattgaaacaatatatatcgtcacatacctaatctacgccacgaaagatgcaagggtaaaccctaatcaccgattatacttactttttagttttatttttttactaatcaacttgatatgacaagtataatctcattagttttgttctaacatgatttttaatcgtagatcttgacgattaaattgttcatggcgatgaatgtggcctgttctgtgttgattgtccttaccacccagttagctatgcatggtaaacttcgtgtgcatgtccttggatggatatgcacatcttttgcaatttgtgtttttgcagcacctttaaccattatggtgagtgaaaattataattattgctaagtgtttttttttttttttttagttttaatttaattctttgttttatggtctcttatatcttatttcttgatttgtaggcaaaggttattcgaaccaagagtgttgagtttatgccaatcaacctatcatttttcctcacactaagtgccatagtgtggtttttttatggtctattgctccatgatatatgcattgctgtaagtatataaatttaacttttattgagtgattttttaacatcaaaatgggctggtccaagggtaaattagtcaataaaccttttctttagctcccgaattaagtctcttgatattttgaggaaacatttatttaaaattccttctctaagaacatatatgcaagttttctagttattggaaacattttctatagtaatgctatataccaaaataatcttgaattacactagtgttgacgtatctttctttttaagaaacaagagataaaaatgtttgtcattatttatgagttaaagtgtcgtgacatatactattttcaataaagtatttctaattgtttctttttggtgacactaatttggacctaatatttgctttaggcccctaaattaaggctctagctagaaacagctatgcaaatattctgaatattgttggaaacatcttctatattacgttattgaaaaaggtcacgaagaatacatgaaatgaaatgtgtacttaaatttccataagattcataaataaaatactagttattttatataatatccaaaagaaatcatgaattacacaagtgctgacatgtcattcttttagagaaacaaaacaaaacaaaacagttaagaaaatgacatgtgatttattgtaaagtggatggcatgtgaaacgatcattaaattattttgtcaatattcatgaattaaatgattttgttgtaacatttctagttgatgaaataatattttattttattgcttttagacccttgattatttttttaaataactttttgtgtctaatgtgcagattccaaacgtgttgggtttcatattagggctacttcaaatgttactatatgctatttacaacaaaagtgtgaaggaggagtatgccctagagccaatgacaaacattgttattgtgaacccattaggaattccgtgtgaagtattctctctcccagttattgataacgtgaataagattgaaaaagaaggtgcagaagagatggagaaaagtgtggaaaacctaacatgaaatatatgcatgaatggtgtttgttgcttggaaatgatatggctttcttcttatgatatataatctcatatgtaatagtttttttttttgttttttttttttgtttttttttatataagtatatataatgttatcatgaagggagtaccccttgtactcctataaaacatcaatgatttgaatgaatatactagctaattcattgttttatatgtgtgcaatattccattttcattcaaactctatcaagtatatctaaaattaattaatttaattaattaatgaatggagtgatatgataatgtgggcttgatatgattattgaaaggagggacgataagagtagaaaagataagaatctaaaagattcaactaccatcattggcaaaaataagcaactaacttttttattttgtaaaaatcaacaaatttgattaatcaattatatcaagtagaaatctaactttagagatgacatatgtcattgttggagttttaaacatctttttagttgagtgtctgtttggtttcaatactttttaacgttactataaattaggtctttagacatgaaaatgtgaagtaacaatttctcaaatttataaataaaaaaagaaagatcgtgcacctcctaacgcggttccaaacacattataaatactaatccacggtgaatcatttataaagatattcatatgagaatatttttcaaaatcattggaaaaatagaggaattaaatctcgttaaatttacaattataaaaattgaaattcattaagctcgtagatttacaattataaaaattgaaattcattttggaagtaagatttagagccaacaagcatacaatggataaaatacaattaagagataagatgcattaagtggttgcaaagaagaaaaaatatgaacaccatctttggaccgttattgagaggttcgtatcagacacaccatgctccggtggtttgggtaaaatcttccattggtttgggtatgtattgattatgtcaaaatatcggttgttgagctttttttgcttctttataaataacgataaaggtcgtaaaatacttttgacggtttggaattcgacaatgtggtctatttagaaagtgaggaatgactttaaatttccctcaaatgttctagtggttgaacaagtagtagtagattggatcatagttcaagcttggatatggttattggcgaaaaagaaggtgctccttgtatttaccaagaatggttcactaattcgttgtattgtattttctcttaatgaaaattcttgacctttgggtttgttaagcgtttgtgaatgagtcgaatacgtcttatacttaatcacaatttgtgggtaaaatatattttgtacttatttcgacttctattaatatatttacacttcaaaatgaagaagtaagtatgtctttaaaacaacaattaaacttttgataaatttttcgacttctattaatatatttgcacttcaaaaagaagaagtaatcatgtcttaaaaacaacaatttaaacttttaaataaattaaaagcacaattttcaattcgaaatttctatttttaatacactaacaagtgttctcatactacatgttaacattttctatcactatattcataacaaattgaggaaaattaatgatataattaaaataaagacttaatgaaaacttcaaaattcattgtactaaactgacatataaaaacaaaaaaaacaaaaaaaaaaaaaaaaaccataatagactgaacctatgcaatttaaagatcttcattgattagacatagcataaaaagtgaaatcgcacaaatagagattttccttgattagccatggtataaaaagtaaactaacgtagaaaatgcaattaaaaacaccattaaaacaacaagaagaattataatctaagattatcaagattttttcctttttattaatttgagagtccgaatcagagttgaccacaggagatggaggcttcgacaaagatggagtttgagggaccacaacaccaccgttcacaagaggagatggaggtggaggaggtaagaagggaagtggtggatcattaaggttcacatcagaagacaaagcagttgatggcatgtttcttcctgtcacaattacgaaaaaacttaatgcgaagaggcagcagatgatggtcttcatcttcatatcaacaaatatgattttctgaaaacaaaaataaaaaaactagtatcaaaacaaaagaagtttaacaataacaatgaataaaagagtaagtatacaacatcaactagaccaagtgacaccaaaaacagaaacaataaacaaaatagaaacaccttagtacaaaaaaaaaaaaaaaaattagagaaaaatgtataccagtttcaagagatttttctgtctcctacgttttattcttcataccaattccttaacttcttattcttatttatttatagaaaaaatttaggtgtaataataaaaaatatcaaatcaatttaccagattttgaaaatatttaaacatgcacattaaaaacaaaaaaacaatatcctggtgtaaaaaatataaatgaaatctgaaaatatttaaacatgcacatttaaaaataaaaataaatatcctttgtgtaaataatataaatgaatattccatttgattttctatttttttatatacctgttttactattttattattgtcgttgttgttgtttattgattagtaccactatattgaagaaaatatgaaatcaattttattattttccgtgtcttttaccttttactcctcatacaaattccttaaactcttatttttatttgttattgtaaaagtataatttataataataaaaatagatcgaatcctccctaaaaaattgatcaaataaattaagcaaatattgaaaagaattttttgttgagaggaaatattcaaaatatttaaataaccacaattaaagaaacaaatatccttgtgtatttttttgttaaccctccaattctcaggtcctgataatctgaggtttggctgaaggtaaataaaactctcaggtcctgataatctgaggtttggctgaaggtaaataaaacatgaccaaaaattatttcacccagaaattgaactcagattcttctaaattgtttgtctttattaaagttcgttaaccacttcagcaacatagcaaataaattatttgccccaaggagcaggtctcaaataatgtttccaattccgatccaagcattcaaaagccttggaacaaacagagaagatgtgcatatgagattccgctaagatttcataggcaggagacacaagattctttgcatggtataccaatgatagaatatgtgtatatttagcaaataatgatgtgcagttattagcattattaccaaaataagtcaaatggcaatttgtattcctgatatactgttgtaacagatgtatattacaaacatcacatatgcaatgaaaacgatcgaaatacattttcctatatggtatcaactaggttttcgatctaccttctttcctagccgccactcaaattcttccacatcactcaaactatcccttacctgcaggtatggcagcaacaacaactgatttagcaaccaacaacccaaattccactctgcttttggaatcaccaacgtgaaatccatcattacaatcacgttggacaacgattcaaggcattatctctcatggtctgcactatttcaagtt

SEQ ID NO: 34 - DNA, 60854 bp, Medicago truncatula
ttttagaatgcatattaataccataaaagtatattttcttgaaaaataaacatttattttgttaaaaatataatacttcaattggtatttttaatagttatgttttacctttgtaattttaatgttagtcttgaggtaattttaatgttagtatgaaaaatgaagggaagaatagtttagtcattttctttatgtgttttttgtgtgatttttcatttgcacacacacaaagtacatcatttaggagaataatcggatacacttccttatgaattgttttaccatcttttgcaattaattatttaaattagaaatgatgtaagataatgtctcaccatattttagatctattatgtacataatctgttaagtacataaccatcaaatatataatattataatgagttccataactcccatcttaaccaactcaaattattgaagccattttcatcaacataacatttctccgaaataaagtactactacctccgtccctaattataagatccttttaaaaaaataacgggaattaagatagtggatatttgtattaaatatgtttgtaattactattgtttttacaattttatcctttaagaaagatggttggtttatgttttcaacattctatttattgttgattgaagaaaaaaatgtataataaataggggcatgtatgtaaagaaataattaatgtagttgaaaatagaaaaagagtcttataaaaagggacaaaaaaatttctcaaaaggatcttataactagagacggaggtagtacaattttacccaacctaaaaaggtttataggtgtgcaagtaaacaaagtaaaataatactttattggtcaatttattttaatatttactaaaataacctgtttttaatttccagattttttttcttcagttttttatttataaattaatctaattatttacacaaaaatttgagttaaaaaaagtacaattttacctaacctaactaaaagtgaaaaggtttatagatgtgcagtaaagtgtaaacaaagtaaaaaaaaaataaaaaaaaaaatagtatgatatgcattgcaagggttttgtaattcgaaagatacacagcgagagagagagaaggaagtagctctttccactgctgacctgacattcatcaatggggagtactgcggcggcggagaaaaccgaacaagaacttcgcaacgagatcgatgaacttcttcgtcaacaacgcgaggttaatatatctatatatctatatctatatattctctaggtattggatttgatttatgattcgttgattttgaattcagataactgagaggcttcgagatcctcgtggtcttcgtaaaggtgctttatcgactcctcttctccgcaataattcgattcgccaacgtccctttgttcgtcacgtgagtttctttccgtttttgttaattagggttcaattcaattatgattcaattcagtttatgtatattttttttttattagggtggggataaccatgattctgaagatcaacctcctgctaaaaggagactttcatctgctgttgttaaggtattttctttttccacttaattttgatattcaagtttagtttttagtttttagttttgaaaattcaaatgcagtgtgcaatgttttatgatttaagggttgtttgttacagattaaatttggttaatttgtttttagtagattctcttgaaaagttcttgattgacgattttatgaaaagaagtgaatttctttatagtaaataaatacaaaatttctttgtagtgtgcaattgtctaataatttaagggaccagctgttatagcttaaattggatagaagatttttatttttcattatggtaaacaaacacagaatagttatggttttattagaaatgtctacaaaacaatatcaaaattattagaaatctctaaatcataactagtagtgtcgtgcccctactcatgtgccttcctgacccctaaaccacaaaggggaaaacagaattgtgtctttttaactgtatatcttgtttggaaatgaaggttggtgatggggagctgactgaggatgctgatgctggaaacacaaaggattcaactggcgacggtgtaaatgggaatgctactgttggtcagagtgatgggaagccttttaattctcaccaaagtggattgtctagaagagacagttatcaaagaaattcaaaggtagtaaatgcaataaatctcttaccttgacgaatgatgattgttggtttgaagttttgtatctaatgctatagtctgttcttcatgtcaggcttctgacattcctactacagaacatgttccgagggtattgcctaagaatgaagacccaagcttggttaataggaacaaaagaatgctgggtcagcttttgggaactctggaggtatgtatgttagtttgattacttggtttttaaaacactcttagattgttgctttaaattataagctcaattcagtagttgttttacggtgtacacatatattctctctgtctcctctatacacttatattttccttttgttctgaactgtaccagaaattcagaaaggaagacaagcaactctcaggaacagaggcatttatgcgaagatcaaattctttgcaaagagtaagtttgctgatgcccattttaatattaagattcttcctattgatgaagtgggctgtaaggatgcagctcctatagccatctgtgttgttaaacataatgcatacatttgacagtagttcactcaatccactttgtttaaggatatttaaaattatgaaatatacctgcactgaaaactgatacaattatgcttggccattgtccttattgattgatattatttgaaatctctcgtaaagacctggtgaaacaatttgatgaatacatcatagtcttgaatatatatttttttgcagaaatactcatttgacatgtcctcataggtaaattttgttacgtaacagatataaattgaaatttaggacttctatttaagcaggattcaggagggcacatgttttcatcttttttgaagcaaaatagccacagcatgcctaagtgtttctttatgtacatcggtactctgatatactccattcttttcacgtgtctcgttattttgttgcatatgcacatgattagtatgtgagagagtattgcccttggtgagcccttattttcaggcctagtggcagttcccttgctaactttttttgatcgatacttccctcctattaagttgttttgcccaaccacctatacaattggctatcaaagtttttgttcaacttttaaagactgcatacaatattaagatggatgatagttaggattacaaattccgaacagacatgttttacagggtccatagttcgaacaaggatgttataagttattagtgacaaacatggacattcgtgcgacaatgatatgcgtgccatttttcttgtagacttcgaatattgtgccaaaatcaaatgtgccatttattactgtgcttgcaatttctaggcccttctatttgaagcacgaaataaattttcttgcttgccactttgtcttctctctatcttttctcatgctaacatccaaagcttcgtaataatctcaaatgccctgaaattccttcctaggctgagcaaagagcacgggaagaaagtgaaaggctcaggaaagaagagcgcgaacagattgctgaaaaacggaggagggacttggtaggatctcaaatgacaactattcttttcacaaagtttcactatggtcccattaacaaatgtttttaatatacatttttcttttgtttcccaactctcatcagactcttagggcacgtgtggctgctaagacagaagaaaagcaattggagttactgtttcttcggtggagtgagcatcataaaagactaagcaattttataaggtttgttcctttcagctgtaaatttatgaggcaatagtttattaatgccaaaatgtttccctagtttgctctacagctagacatctattactgtatctaatgtcataccatgcaatgctctgcaggttatttttatttttggtccaaaagtgtccatattcgcattttattgagacgaagataagtttctgttcaattgcattgtaatattgaagcaatttgatgactggatgttcatgctaattgcagaattttagataaacattaaagtttttctttattctttttgggctgttctttgattgaatgtatttttgcaggactaaagcagaacctccaatctactatttgcctaacaagcccttggatgaagaagatgtgtcaactaataagagcaaagaagaggtagtcaaacttaggcatttgatttgttttggtttacatcttatgtatcattttgtctaatatgaaccgtcatctatcattagccctgttaaatttctaatatgatctatattttttttacatggatgtttgtgaatgcattctcaccatcacattggattcaggattattgacttataaaatgtacgtatcttgttattttatgtattgttcatctttgcaatttgcaggatttccttgaatggaaaaatgcaagaagagaggaattgtctgagtatcaaaaacaaattggggaccagtatcttgccaatgttgagaaggatttggagagatggcagaatgcaagaaatgcaaggaaaggaaacaatgatcagaatttacaagaaacaatggacaaagaattggatactcataggctcgagcatggtcccaagaaaagaaaaatccctgacggaactaataatgaagatgatgacgatgatgtggaagatataaatgtcggagaggatgatatgatggacgatgagttagatgatgattctggtcgaaggattgatgaaacaattaagacggaaacgagcaatgccactgcagatcctgcagctgctactgataatgaagacctaaagtgatggcccgccacgacacacatcaattattcagtgagatgtttatttttttgtagtttatcccttgctatggttaggcttctgtattaaatttgctgctttaatatttttctgtaatcaaatgtactttctctatttttgtgtctgtatttttgggtttattttttgtttcgttaacgagcaaactaagaatgtctatcttatcttagcatacgtgagtttcagtctgctatttgtttttcggcttaattggacttttggtcccctaactaatttgttgttttcattttagtcccataacttctaaaatcaacgtttcggtcccttacaaatatcaccgttagtcaaattgatcccctccgttatttttttaatgtctaaactttttgatatgattttaaccatccgattgcatgtccattctagttaatagtgaaccatcatcatctaattttttcacttttctctctttctcttttgtgtgtttttacggtttcaaaaaaaaaaacacaccacaaacattttccatctctcaatcttcatcaccttccatccatcttcatactctcaatcttcatcaccttccatccatccatcttcatacctttaaacccagaaaaataaaaaatcaaattcttttttcaatcttcatctcttcttcttcttcttccaaaacccataaatctcaaaattacaatctcatcatagccaagaagaattcggacgtgggttccatcaccaacataagcgaatctgattcgtgcaacacaacaacacaaaagcaggaaggaggaataagaatttggattcgagaattctgaattctccaagcggcgcaaataacagcttcaagtgttccttcttcaccggcagcgataaactcgcaacaaccgtcaacagcgtggccaccgaagctctctctccctctcttctctccacctatactcttttttttttcttctttctccatcgaagctctctctccctctcttctcttcttctatacagttaatgagatttgaaacaaagctgtgaaccgaggaaaagaagcgcaaacgctgctgcaccgttactgagatttgaaacctaaacatgataacggatttgcaatccattaattgatagagtaagagaatctcggtgaccttgctctgagcgagaaagaagatggatctgcgatcagtacaaggagagaaagaagatgatgttttgatattgataaatggatctacaagggttattgttttcttttgaagaagatgaggtgttgagagtatggagtttgcgtgaggtggaggacctccgtcggggctctctctctccctctcttctctgcacagatgcgccggtgcggcgaggatctcgcaggacctccgtcggggctcgatgcgggggaggaggaaaatatcacacttgttttcataataagatttgggtttaaatgagtataggtgttctgggtttaaatgagcatgaagatgaataaagatggatgaagatgaagaaaagaaaagaaaaatcacgtgatgatggttcatcagtggattcaatggtcttgcataatctaaaggatttattttgttttaaaatgatctaagagctaagattaaataaattaataaggtctatggtggaccatttaccatgtcggtccatattagatatttgatgttaaaattaacggaataagactaatttgactaacggagacttttgtaagggaccaaaacgttgattttagaagttatgggaccaaaatgaaaacaacaaattagttaggggaccaaaagtccaattaagccttgtttttctagggatgtgtacatttttatatatttttcattgtttaacctgtccatacaattacaaaggcttgttaccgttggttatgaatcacattagagaattgttgttcccacatttgataaggttgtgccacactagtaaaatacgattttgctccctcggcagttaactgccgaggaatttgaaatccgattgcagttaactgtcgaggaaaacctcggtattcatcagatgaaacagccagccacctgctccccctacatactattttcatcatcaacttcatttccacctcattcaatcccaaaattcaatatttatttatttttttatcaattcttgatccaaaatcattcaagcatcaagcataggaggtatcaacacacttttgacgtaaaaaaacaggtattgtgcattttattcgattgattttttggttatgttatgggtttctacgtcagttacgtagaaccctgtcatgggaatcctcggcacgaaaattttggtagtaaggtgccatggaaaacctcggtagtaaggtgccgagaaactcttgtgaaaaattttcacaacgtaaaaatggcagctactgccatttttctatttttttttcttttattttttaaggcttaaataggtatttcgtccctgcaaatataggtcatttgaattttcgtccctgaagttactaatccttccaatcggcccctgcaaatattaatcatttgacttttggtcctaattacatttgattagtaacttcagggacgaaaattcaaatgacctatatttgtagggatgaaagacctatttaagcaaaccacgtcgcccaatcatcacttgccacatgggcaccacgtcgctaatggaagtccacctcaacaaaaaaatctaattaggaccaaaagtcaaatgattaatatttgcaggggcagattgaaaggattagtaatttcagggacgaaaattcaaatgacctatatttgcaggcacgaaagacatatttaagcctttttttaattcattttttaattcagctatgtgttgtataatctatgattctttcttaaagcttttttcaagtgagacatgtctgaggttgcacaaattgaaggacgtgttaggtactccgtgtttaaaaagacggttaaggttatgataacgtcgacggactctcttgacgatttgaaggcacaacttaacacttattttgagcatcttggtgaaatcaatatacatgtcacttgtttggtcaaatgccatgcatagacctaggagaagatagagataaatacgcatggaaaacggcaaactatacgccttggtttatttgtgacgatagcgacgtcggatttatgttttggaatatgatggaagatactatattatatatgtatgttcgttccatatgcaatttcattgaatgtaagtagtgatttaatttaatgatgtgtaatgaattgtttaattatgaaagttaaaaaggtgtttgacccataaaaaattctcccttgatagtaaatgaatagatttgatggatgtagtttctatgtagtattgaatttttttagtaattttctgttaaatcctctcatcaaataataatataaaatttcttcaatttaactcttttctctcatctcacattatctgtcaactattctttcatcttattttcttcacaaaatcaatcaaacctggtgtgcaaatgcatgagtcaacattgtggatcaatcttttactttttgtgagatgagaaagaacatccagcttttactcaaaaggcgccacattgataatttttttctttgacttttacaacttttggttgtcatttaatttagggttaatagtgtttttcacccttaaaatatacgttatttctgattttcgcccctataaaatttttggtttgatttgtaccctcgtaaaaattttattttccggaaaacacccttaataggccatttttagaattttttttcaagaaattttggtttttgaatggcctattaagggtgtctttcggaaaataaaatttttacgagggtgcaaatcaaaccgaaaattttatagggcgaaaactggaaataacatatattataggggtgaaaagcactattaaccatttattttaattggtagtttaaactaaaatgttttactgtattggtgaagtgatatatgatctgttggaggtgaaccaaaacaaaaaatgagaaattatatttgtacaattattttggtacaactttttctttcatattcatatattatgtttttattctctctctacctttctctctctctctctctctctattgtttttgaccaatgaaaaaagagaacaacaaagttgtctcaaaggttgtaccaaaatagttgtcaaaatatcactactcaataaaaatcaatatcttagtgctttctaaagttctagcaataattttctcaagttttagaaacaaactattttcttattcacgtgtccaatactctcaccttttgttgggcattcctcctccaccaatcattaataacattgttaatttcgaccctgcctaaatttcgatgatgttgctatgtaaaaagaaaaaggaagaaaaacgaattgttaaagaattaatctctcttcaagggttttcttagtgggaaagaaaggcttgtgatgtggttggagcctacttctagagctttggctagttagttgtctttaatgaatttaataaataaagtgttataaaatgatccgcttttggaaaactttgagatatttgagaaacgtaataatcaatttgatgttgaaaatagatcgagtactttagttatggcgttattcctcaatagatcacccgcaaactttcttttgcaccacatgaaattgcaaaagaataaattccttggtatgatatgaacttacaaaatgcatataaataataaaatcgacatgttatagtgagtaatcaaatagattcgtcaagttttatcattcgaacttttgattttcgtgtgattcgttcttattagaaagcaaagcagccgaaaatgcatccaatactaacaaattttatggcctaaattgtgctagtaaagaagacggatattgcctcgaacattttctatacgagcatggagattaaagacatgcgagaatgaatagtgtgaagatagatgaatgattttgattggtgttaactaagattattaaagataaataaaaaatttccaaaaaaatatatacattgttcatcctaaaattgaggattggtcttgacacaaaccttgtatgaatatcacacaggatgagatccacaaagatgtcagacagtcagagtaccatctttctaacacagcatgcttttgatttgggttactgtcaggcatccttgtttgggaaaccattcagtcttcctgatgttaaaagaacatgggaattttaatttcgagttatcctaactcccaagtcaattacttgtcaaatatagaattttattttataatttggtactaattcattgattacaatctacatcacataaattaacaaaaaagcgttgtgctattgagtttattaattactaatagtttgcattattttataaacttacccttaaaagaaataatttatgtttctataatttgggttggcaagacaatttttttttttagcttatagcttattgattacatcttataaactcatttaattagtaaaaatttttgtttgataatggttactttctcataagcgtataacttatttttaccaacttataacttataaactatcatttttatctcaatttttcctttgcaataattgaaaaaaattagctattaattaaataaataatttaatgtcattttatatgtataaactagattaactactaattttgaagtgtatgtatgtttaaaaaagaaagtaaataattagattgattttgaagtgtatccaaaaatttaaaagtaactatttattaccttcttttttttttcgatactttaatttatctttcttataccattgattaagaataattttgtaaaataatttttagcatatcttttaaatacaaaattaataaaattttctagtagacgtgaaatgaccaaaacatagtataatttaggggaccattaaatttagcaaacatggaagaaaataaaaatttatttgatagaagcattataaagaagtctcattattgtcgaaatcaatctttctttcgttctcactatctcttcttccagaaacagacaatgactacaagaacaaatcaaccaccacaaccaaacggtgttaacggcggcgaacaaagaccacgagcaccaccaccatcatcctactcaaacggcttcaacaaccaccctcaatactacccaagaacaccagctcgttcctcctcctcagcttccctaaaaggctgttgctgctgcctcttcctcctcctatcattcctggcacttctcacactcgcaatcgtcctcatcatcctcctcgcagtcaaaccaaaaaaaccacaattcgatcttcaacaagtcggagtccaatacatgggaatcacacaaacaccgaacaatatacccaccggcgccggcgcttcactttccttaacaattcgtcttctattccaagcggctaatcctaataaggtagggatcaagtacggcgagtccagttttactgtgttgtaccgtggaatcccattaggaaaagcttctgttcctggattttatcaagatgctcatagtgtaagaaatgttgttgctaccattgttgttgagaaggttaatttacttcaagctgatgctgctgatttgattagagatgcttctttgaatgatcgtgttgatcttagggtttcgggtgatgttggtgctaagatccgtgtcatgaattttgattctcctaatgttgaggtaattatttattcgtagattcattttttctttttcagaattcgatattattattattattattgccatttttagttcaaaattaagtaaatcttcttcactttgtttttgtttttgatgtagaatagaatgtaacattatcatgggattgtgttttttttagcggtggtggtggggaggggtagcttgttttccacaccccactcacacattgctgctttttcttaacttgtctttattttcttccttaggctaacgtgcgccgaaagttatttttgtttcttttttaaaaggaaaaagttagtttggttcaataaattaaataaaatgatgttgatagtatttatttattagacttttatgttttgaatattgaaaatagattcatttccatctagtttgatttgattctatttttggggtttttattaaattttgtaatttgtaattccccgtaattgtggcgattctttgtgaaaggaatcattttacgatctttgtttttttggggtctacataggataagatggtaaaatagtgcggatatggtaggttaggttagggtgtgtgcataattagagtgtaaccggatttggatatgttctggttgcaattagaggttttttttttttttttttgcaattttgtcaaatggaatatgttagtgtttttttatgtctttaaataaattaaaaaaaaaactagtgtactttctttttactacaagaaatttaattattattaatagtagtaaaatatgatatattaacttttttggtggtggccgggatttaaacctcgtaccttttatatattatacattttttaccaactaaattaagtacacgaatacaaaatatgatatattaacttaaattagaatgttcaaaatcgttctcatattcagaaattgaattcattactacttagtaatcaacaaaaaaataaatgaatatgagaacgattcttcttttttgtctaatagtagtaatgaaattcccttaaaaaaaattcatgaatataatagataaaagttccaggtttatccttacaaatgcctattaattttcttgtaaaaaaaatgcctattaattttgaccacaaatgctttggtcttttttgtttttcacccacatgagtcatatcgtacaattatatattacttttccttatcaccttttgatattatcaaatcaacttttgtattttagtctataaatttaattgatgatatatgggcattttttaataattgattatggttttctatatattgagtgctttcttttcacgctcttttatatattcgtctctgggtagcattgtggcaatggcaagacattccaatagcctcattattgtgtgctagtatattgtttttttgggactaaaatgtgctagtttattggcgttgttacactctcttttttgtgtgccgatgactatagtgaagtatttaatttcaagggtttacaactttactttgcattttttttttatatgaaaaacatagtggaataggaattggggaaccaaaaataccaaggtattatttgagagtggaaaggttgatgttgaggacccatcttatatagcaaaatagtaagaaatgattagaacgtgaaaatgaaatgataaaattgttaggccccacttgatttagaagctggattccaagaccagggtaccaaccaaccactgcaccatgttatcaacaaataacaccctttatcgcccgcacaagttcaataatgtcattctaatggttaaattttctctccatttttttagctgttttcctttagaaatatgtacgtgaatgatgcaatttttatctacttcttttaggtgtctttgaatttagattccctatagtcatgtgagcacaatttagtgtgggcgggttttagcatggggcaattgttaaattgttccatcttaaatcaattttgttttatttgctattaattgtacattctataattttatatttcaatttatagctctatttaattataatatatcaattttaatttaataaggactaaaatattttggagagacaaaaacatgtcatttttatagaactaaaaataaaattcgttataaaccaaaatttttagtccccttttaattaatattaaaattgtgtgctgtgttgttttagagggacaaaaacatgtcattttgggtgagctaatttagagggacaaaaatatgtcactttgacttgggattttgaagtgtgtttcttctcaaggtctcatgtttgattctccctatgtcaatttgagtggagtaatttaacttcttcaaaaaaattcgctatatttataaggaccaaaaaattattcaatccttaatattacaaagttttgttgtagggtttaatattacaaagttagatacaaactaaattgatttatttataaataatgtagtatatatatatatatatatatatatatatatatttataacatattttttttatcccagaactaatcaagtctatgttttcaaattaaaaaaaaaaaaatattaagactgttttcaaattaaaaagattattaagaatgggccggatgtattagatttttaaacgggagattaaaaaataacatattcataactaaattaatttgagtcaaattataattgaatatgtttttttttcttcagcaaatataaggttatacaagtaatagcaaataaaacaaaattgatctaagttgggataatttcacaattgtcccatgctaaaactcgcctttagtgagcttatacccttagattaatctttttctttcatatctctctctcaaaatcaatatcataacaatagagtcttcaaatcttatttcatatacattgatactataagatgttggataaattaaactaagcccgttttatctaacttcaaaaatcaagtttagaatatgtttaaacgaagcatacaaatgtcaaacgcttctgccaacatgtttaaactttttaggccaagaaagtcttcaccatgtgactatcctctttgtggggcacatggggtgataataatggcatcatccttctgctaacgtgaacatacattttgatcccctcctcatcttccttttttattttaagcaatgaaactttactttaaatatttactccaatttcctgttttctttatgtttcatgttcttgatattaatcagtattgttttaattaagcattgcattaccaatagattaacaattgatcatgaactaaacttcacaggtctcggtggattgtgctatagtgattagtccaagaaagcaatctctgacttacaagcagtgtggattcgatggactgagtgtttaatgaagaagaatagtgcatataattcttgttgacactatcaatgtccttaattttcacttgatttctctctcaactctcatttcttcaattaattttaggaagaaatgagtaggaaaaaaatagttgattagaggaaatattgaatttacaatggctatcaaaaaaggagtctcaacaaattgtttaactccatagtcatgggtgtttttgtggaaaatatattaaatcagggcactaagcatttttctcataagaatttttgcataatcttctttcttatttggttacttccattgtaaggaagaaaaaaaaatctgttgaccagtttgcaaactgtaaagttaatccaattagtgggtgaagcatctgggttggcttttgttaaagctctctcccaacccaaacccctttctatcttctaacctttttgtttcctcatcttaaattgtcccatttcaaaagagccttggaagttttatccatttgattattagaatttaatgtaaatcatttctttaattttttgggctataatgtgttttgattaatatatggtttatttgattagtttataagttacttcatttcatatgataacttgtactttatcactttttcttttattcttactcaatttaataaaattattctattatcacttttttcctaagagtcatgacactcgttatctagtatactttactatgttaatgtttgattgtgagaataaagtgaggatggatgatgatggtgggaagaaagaaaaagatgtcaagggggagtacattaaatatattgtttgatgtgaattaacgagtgaaagaggaaagaaaaagagatgttgatattatttctatttttttcttcatccaattgacccggctagtatatttttcccgatccaccgaatctaatccctttgtcattctccccatctttctcttgcaactcttaatatagtttttataagtaaatgatgaaaaaaatattttgctatgtgctcttgcagctctacttatagtccctccttcatgagaaatacttaaatgaaattgagttttgctgacattatttgtattgtgtcacattagcgtgtgctccttcatcactcacactcaccttgctctgataagtttctctaacatagtttggttgcattacatcaagacaacaacgactctttcttcgacatagacacccatgttttttttttacgatttcatccattattgttatttgcacacattcacaactcgatataagaaacacgtgattatggaaatatataaattatatcgttttgtctatctaatttacttgtatatcaataaatattaaagcaaaagattgggtgcagagggttcacctgccgcaacatcctaatcatatataagtaaaagaaaatgaaagtacaaagagaaggtgtacaaagagcaaaaccctcaaggaaaataaaaagcaagagaaagctcaactctccaattgaaaacctttaaaagtatttttgccaaatctgttagggtaattttcttataatttatatagaggagtcgacttctcacttgttcttacattgtcatgtttttggttctctatggcaacttatcagatcttggattggagtgactggtgttgatacatataatgtcagtgagcacttctaccaattcattcattattcaggttatacaaaggcgtgtcgctcttttcttcaattattatggttgttgtgtgtttggttgttgtgaaatgaacgaaacaacaaattgttcaaaaacactgcaacacctattgagcagttgttagataaagttaaatttcattcgttgtggtggcttaaagctaaaaaaaccacttttgtgtacggttctcaaaattggtggtcgaaccctttatattgtttgggtattgaccgactttttcttataattatactttgtgacagtttgtttttaccgggttggaacatttagtacaccttgtactaaagcgtttccatcgctgaagttataatatttcattttgatttttcaaaaaaaaaaaaaaattcttataatttatgagggagagagtaatctactactactatttattttaatttatacattatcttttaaaatttaaataaaataaatattttatcttggtacaaaatatttataggatttaaaaattagttaaaaatatcttgtatataacttacttaaaaataaattttaataattttctcataaatacttgggcttccctctcgggcctatctgggcttttctttgaacggagaaaaacgacgtcgttaggatgaatgataaacaaagatcgcgcacatagaaaaaccttacttgcttgtagtttggtcggttaatttcatctatcatcgcatcgaattcaggtatgaatgcaaagtttggttttgtagattttgttttctcatgtcattttttagggtatgattttaatttttcccaattcgattatttacacggttagggttttgatctgaaaccagtatccgtgaagagagaagaacgtaatggatttatcagcagtgaaaaccgcattggaatccaaatcttacgacaaaattgctgatatctgcgataatctcatgcttcaggttcgtttctttcactctcactgtttccttagggctttttttttttttttttttttgtttgtgtaattcgttgcttacttgattgttgatacttactcaggttgctgccgacggtgttgcgtttcacgatgaatggccctactccgttcatcttctcgctcatttttatgttcatgacatgtaatctattttccctcttcttagttttattattcatcatgtatataaataaataatgaagatggaagtgttatatgcttcaagttaaattagtttaatgttggatgatatattgctactgttataatctttgttttatagtaactgacaatgtgccgttagaattgacttattttagtttacctacttacattggcatttgccagactcgcccgacactttttgagcttatttacttacataagctcttgtgtgactatttggtagatttatggaaacaacctatgacatgtccataagttgtttttagtttatttccataagctgttcaggattgcttattgaaaatagcttagacatgtctataagttgttttcagtttatttccataagctctccgggattgcttatgaaatgaaatagcttatagcttatatgaaaatagtttgactttattttatgctatagaaacagctttgcataagtatttatatgagaagcactaatgctatagaagtttatttaagttgtttatccaaacaggaccagtattttgaaagggatggagttggttatatgttatgttttgtaactttttagattttaggttttctgtttgctgttgtgatattgcagcaacagtgctcgttttctatggaaaacaataccttcctcaatcaaagaaagcaaccctgaagtcaatgctgtgtggaaaattggtcaacagctttggttaaggaactatggtggagtgcatgaggcggtccgtggttttgagtggagtccagaactccaatgcttcatttctgctttctcaggcaagcatttaagaatttttttattttgttttgttagcagagctttgaaatttatgtagaaagaaactctttgatcttcactatatttaaggcatgattctgttcaatttatcttcactttaaatatcttaaaattataactgtataagctgttaccatttaaccatagacccctaatttatctaaacgtatcccttgattttattataaccaattatatcttgttaattttgacaatagactattttatcaagaaagtaagtcatttctgtgtgggacgatcactaaagcatggatgtattgattattgaatctgtattattgttggttgtttacattactgtatttagtgttcaagatagtggcatgttgccatagtattgtttgttgtttacattactgtatttagtgttcaagatagtggcatgttactatggagggaaacaagtgactaaaaattatcattggttgtttgcactactgcatatagtgttcaagatagttacatgttgctttagcatgttatggatggaaacattgcaaaaagatgaattactttgatggaaaaagtgtaatatagtttgaacctgggaagaacagtgattgatcacttgtttttggatgttctcttcccctttaaatataactaaaaaagaatttgatgaataatgtaatttctttggccagcatgtaatgttgacgaaggtgccacggatcacataaaatttagtaaactagtgatgtgccacttcttcaattgttttaataagtatgtttcttgcttttcaatttattttctaagcagtttgactgcaaaagtcttttgcatctatatgttttttttcttccaaatatgagttgtacagtgcaaaagttaatatcaccaatatgctttttccagaactttacacaaaggagatttttcagcttcttgtatctgcttattctacaataagtgttgaagatgctgctttatttctgggaatgagtgatgatggtgctacaagctgtaagtaattttatgttcatttttaaatcaaacaatgcatgtctatttgttttagcaccttttgtatcataaccaatgttgtcctgatatttatttttacattaaataacatctacaagcaatcaatgcatttattataacatgattatgttcaacattatttctgcatgactagatgatactctttaatgtttggcccctatcctttcttgacgaccgttgaaccgaaaatagtccttttaatcttgcactcggatacacattcagtgaaagtggattccaattctccttgttgtattccatgcctctactgtcaatatatctactaactaattggatttttagtagagtgtagagtagcgaatcaaaattttatgctaaaatgtgatgggcaataagagaatctttaaaggttcctcatgtaccatgtgatgtaattaatggaagtcatatagatatagccgagagtcctgttagtgacatatatgttggatctttattagcgtagcttctgcactcaatctttaacctcttaaatggtttaatcttatattagtgtctcactttattgggtttggatttaaggtttgtttttgggtgtattgacactgtagaaactatggtttggaaatgtatgttttttaaaagagagcagttgctgaatttgaggccaactgtttcttgaaattttaagtagctgacaagtttacacttggaatgaggagaaaagggaaggtagtagaatgaacgtagcgctatcaattcaaggtgtcaggcagtgaaaaatggaggaggaaataatgggggtgggaaccaaagggaaaaaaaaaagaatgaaagattacaactaacctgtgctatctaatattatcagtttaacttttccctctcccagaaacagtagaacttggatattggttatattttgtgcttggattgagagagagaataatcaaaattatatttgatgcccaaatcaacatgattattgacattgatgatgaatcggtgttgtcatatagtggctatagcagtgctttagtgctacaacgtggcggaattttgacaaaccgctattgctccccagcgatacgcaattaagtccaaaatgatgtcaaattgcaactaatgctgtagtgtagcgaaatttgaacaatccactattttccaccatctacaattgacaacactggtcaatctggctggctggaagtgaacatgacaattacttacaatgagctatcttggaaaggcagctctgcttgtgtagtcttatttttgctgccttttgaaaatttaatcacgcattaaattatatcaaccatctcttcccttcctatgatatcattatagactttttgattgtatgattgtagatgtactacaacaaggttggaccgtggacaatgcctctcggatgcttactgtgaagaagcaacctgttgtgtcagtgcagaaacttgatccttgcaaattgcaacaactgacagaatatgtcttccatcttgagcattgaagcttttaatcttgtgaaggaattagatgaatgtttttctaaaactcttcaatcacgtgatccaccttttgaaggtgtatgaaagtgcatatatgctattgatagttttggaaacaaggcacataacatttcctgtgttttaacttgagctctggttagatgaattttgcacggcatttccgttagttattgaacatgccgttctcttgtatgatagcgaaacgtaaagaattatgctgattaaacatgcgtttgagaaacccagttactatatattcttagtatagtgaatatttttttatggtattatgttatttgtaggctggggatagttaatatgtattttcatcataattggatttagattgctactttctagaccaactaactggaaagcgaaactgtgaactagttgaataaagaaagctatgacctcacatagttgaattgaacgtgttacaacttacaatagttcttgttggaacctccttactaaaaatgaatagttatcggaacctcttaactaaaaacaatagttcttagaacatgaattttatgttttcttaaacttgcccatgaactacgggtactattgcattgcctaacattagcttacctgcaaacttgcagttagtatgtgaatctaagatgacggatgtcaatgatcatcgcaagcgtgccttatcagcgatgtgtattttgagactctagattgtatttggaactatccatgatttggagaataatactaagaaataaagccaaagcttttagtttccggtgcctatctcagagacattggtgaccggtagtagcatatttcagcataaaactagattatttgcgcgagtttttatgttttgttcgtgtacttgagcaaagaatttatgcacacacgagctggttgttttccttatttatgatgagaaatcatattttcacgcacatgaccttctacctcgtgcacacaaaacaacaaaaatccaattttccaatttaaatttgaaacaatcatctcaaccctgattttcctccatttttctgcggtgccatttaatttgggaaagaactctcctttcccaaattaaatggcacctttttctgccctatttccccttccaacctctaaaaatccacaacaccttgaagtctctaaattcacccacgcaaaatctactacacacactctaaactcactcctcaaactctaaccctcaccaccattttctccacatgcaacagacaatcctttccgttaatttgtaattggatagactgaatcacacattcaaaaaatcaactaaataatctcaaatgtcaataacagtaccgtgacacattaaccttatgttatattatcattatcatattataaaaataaaaatataatagcaagtgatgtgatgattacacaagtttagtgacttatgtaaaaaaacctcaaaacgcagggttaatgagttttaatgggtggatttgcagaagcaaagcagcttcaagggtttttgttgggtttttctcttccactcctaagaaatgaaatgaagtcaccttaattttcatttcactcttccttcttcaaacaaatgcatagacgacaccgtttcactctctccactctccgccatctcatccacacaaatccgttcccattccactcacacccccctttccctcccttacacccccctcctcgccacttctccaccactcccttccgccgtccaccacccgacccaagcgacccttccaccctcctcaaggaagacgctttctccctcatctccaatctctggattgataacttccgccaacccgataaactcatcaccaacctctcctccaccctccgccgcttcgaactctggctcctcgcttaccagaaagtcaccaccgatgaaaccggttcctacactcctcgctcctccatccaacgctctgaactggaaaacctcctcgctcttcgtaactccgtcattgacggcaatttcaaatggggctcccgtctcaaattcttcatcaaatcacccattgataaaaccgatcacgattcgttatcgaaaagaaaaatcaaaatcatcttaaacaccacacaacctacgccttttcaagataaaattgttcaggaggttttattaatgattcttgaaccaatttacgaacctaggttttcagagaaatcgtacgcttttcgtcctgggaggacgccgcatacggttttgagggtgataagaaggaatttcgctggctatttatggtatttgaaaggtgatttgagtactttgttggatggagtaaaagtagggttagtgattaattctgttatgagagatgttagggataagatggttgtggatttgttgaaatccgcgttggttacgccggttgtaacgagtaagattgatgatagggaggtgaagaagaagaagaggaagtatcagaaaaagagggttttgaatgaggatgagccaaagccggatccttattggttggatactttttttggatttgcgccggaggaagctgagaaggttccgagttgggggcattgtggggttttgagtccgcttttggcaaatattgttttggatgagttggatcgttggttggaagggaaaatgaaggagatttacgttccttctaagagtgatgttatatggaatagtcccgaaggggaagcagagcaagggaacacttcttggccggagtttgtgccgactagtggaccggataaaactaggaagatggattttataagatatggaggtcatgtactgatcggtgttcggggtcctagagcagacacagcgacgttgaggaagcagttgattgagttttgtgatcagaagttcatgatcaagcttgataacgaatgcctccctatagaacatataaccaaaggtataatgtttcttgatcacgtgctttgtaggagagttgtttatccgacacttaggtacactgcaactggtggtaagatcattagcgaaaagggtgtaggaacacttttatcggtcaccgcgagcttaaagcaatgtattaggcaatttagaaagttgagttttcttaagggtgatagggatcctgatccacagccttgttttaggatgtttcatgccactcaagctcataccaatgctcaaatgaacaagtttttgtcaaccatggttgagtggtataggtttgcagacaataggaagaagattgtgaatttctgttcttatatcataagaggttcacttgcaaagctctatgctgctaaatacaagcttcgctcgcgtgcgaaagtatataagattggtgctcgaaacctgagccgtccgctgaaggagaagaaagggcagtctcctgagtaccagaatttgcttaggatgggtcttgccgaatcaattgatgggctccagtatacaaggatgtccctcgtacctgagacagattacaccccattccctggtaattggaggcctgaccatgtaaaggcattgctagaatacataaaattagcagatccaaagactttggaggagcaacagagttgcatcagagaacaaggtcttgttacacctcaagattatatttcaatgcttgtttggaattacaaaaggaactctcttcctatggaccatctctcattagcaaagagcgacgaaattattgtagggaatcagcatttgctagcttcctcaaaccaggacgacacaagcaaagaggaagaaaatgatgcaaggataaatgaagcacaaatgtaacaaaagggttcgtaatgtgcacttgcattgaaatgctttatttatactatatttttttgtatgtgttttttgaataggatctttcaagatactcttgttattttaccttcctcctcttcctctctgctttatctaccttttgatctaatgtgtagtcattaaagtgtattacaagaatgataaatgttacaaatataaaagccatgttgctatggatggaaacaagtgactaaaaattattattggttgtttgcactactgcatatagttacatgttgctttagtatgttatggatggaaacattgcaaaaagttgaattactttgatggaaaaaagtgtaatatagtttcaacctgggaagaacggtgattgatcacttgtttttggctgttctcttcccctttaaatataactaaaacagagtttgatgaataatgtaatttctttgaccaacatgtaatgttgacgaaggtgccatggatcacataaaatttagtaaactagtgatgtgccacttctgcaatgacttttgcaattgttttagtaagtatgtttcttgcttttcaatttattttctaagcagtttgactgcaaaagtcttttgcatctatatgtttttttccttccaaatatgagttgtacggcgcaaaagttaatatcaccaatatgctttttccagaactttacacaaaggagatttttcagctttttgtatctgcttattctacaataagtgttgaagatgctgctttatttctcggaatgagtgaggatggtgctacaagttgtaagtaattttatgttcatttttaaatcaaacaatgcatgtctatttgttttagcaccttttggatcataaagaatgttgtcctgatatattttttttacattaaataacatccacaagcaatcattgtatttgttataacttgattgtgttcaacattatttttgcatgactagatgatattcattaatgcttgacccctatcctttcttgacgaccgttgaaccaaaaatagtccttttaatcttgcacttggatacacaatgtgttcagtgaaagtggattccaattctccttgttgtattccatgccactactgtcaatatatctactagctaattggatttttagctagactgtagctgtagagtagcgaatcaaaatcttatgctaaaatgtgatgggcaataagagaatcttttaaggttcctcatgtaccatgtgatgtaattaatggaagtcatgtagatatagctgagagtcctgttagtgacatatatgttggatctttattagcgtagcttctgcactcaatctttaacctcttaaatggtttaatcttatattagtgtctcactttgttgggtttggatttaaggtggtttgtttttgggtctattgacactgtagaaactatggtttggaaatatatgttttttaacagagagcagaagctgaatttgaggctaactgtttcttgaagttctaagtagctgacaagtttacacttggaatgaggagaaaagggaaggaagtagaatgaatttaggactatcaattcaagaagtcgggcagtgaaaaatggaggaggaaataatgggggttaccaaagggaaaaaaaatgaatgaaagattacaactatctaatattatcagtttaacttttccctctcccagaaacagtagaacttggatattggttatattttgtgcttggattgagagagaataatcaaaattatatttgatgcccaaatcaacatgattattgacatttgatgatgaatcggtgttgtcatatagcggctatagaagtgctttagtgccacaacgtggcggaattttgacaaaccgctattgctccccagcgatacgcaattaagtccaaaatgacgtcaaattgcaactatataggcactataatgctgtagtgtagtggaatttgaacaatccactattttccaccatctacaattgacaacactggtcaatctggctggctggaagtgaacatgacaattacttacaatgagctatcttggaaaggcagctctgcttgtgtagtcttatttttgctgccttttgaaaaattaatcacgcattaaattatatcaaccatctcttcccttcctatgatatcattatagactttttgattgtatgattgtagatgtactacaacaaggttggaccgtggacaatgcctctcggatgcttactgtgaagaaacaacctgttgtcagtgcagaaacttgatcctcgcaaattgaaacagctgacagaatatgtcttccatcttgagcattggagcttttaatcttgtgaaggaattagatgaatgtttttctaaaactcttcaatcacgtgatccacctttcgaaggtttatgaaagtgcatatatgctattgatagttttggaaacaaggcagaatctttcctgtgttttaacttgagctctgcttagatgaattttgcatggcacttctggtagttattgaacatgccgttctcttgtatgatagcgaaaagtaaagaattttgctgattaaacctgctttttagaaatccatttactctgtatattctttagtatagtgaatattttttcatggtattattatgttacttgtaggcggggtaatactgatagttaatacgtattttcatcataattggatttagattgccactttctagtccaactaactggaaaacgaaactgttaactagttaaataaggaaagctatgatctcactttgttgaatttaacgtgttacaacttacaatagttcttggaacctctttaactaaaaatattagttcttggaacaggaattttaggattttttaaagttggccatgaaccacgggtactattgcgctgcccaacattagttgacctgcaaacttgtggttagtattttcatctaagacgatggtgatgatcatgatcatcgcaagcatgccttattagtgatatatattttgagactctggagtgtatttaaaatcgtggtccggaattatccatgatttggagaataattctaagaaataaagccaaagctttgagtttccggtgcgtacctcacagaccggtagtagcatatttcagcataaaactgctagacggtagacacaattttattatccacttatattcaatgataacctaaacaatttggtcctctatctctactcgaagaacgagcaacaaaatttgttaaccaaaaaaatattatgcatgaatataaacaatgttcagaatcaaatataatgtttctgcgtatagctaataaatactattgtaaataaatactattgtaaagtatctgaagatcatattacatctatatgaaacctatctaaagttaacttctaacacaagtcagttgttaatgtgacctaattcttattaaagggaggtacaataactataggatctgtaactctatacacttcttcaacatatcgaaacctcttgttcttcctccttaaccgttcatcttcttcaatttctgccaacacatcctcaactgaatctgtgggtgatgatggtgaaatatcatcactatccttactccgttgcgtcattgattgcaccgtgacgctgttgctgctattgctatggcaattttcatccaagtaggttgtgctattactaagttctattaggagttttgctgcatcaatttccgtaagggagaaaaaaccatactttttcttctgggtgttcttcttttcgcatgccattgagagagggatagaggtcgcaggttcttttaaacatttctttccatgttgtactgttttctgttttatccttgtctttttatatatgtttttttctggacaatctgctttatggttattttgattattgtggttattttttttctatttatgtctttgtcatgctttatgtatttgaaccacacgctaacgtgtcgggttctaaatatctttcaccaagttatcttaacgagtccttcattgataaggattgtgatttttaaaatctctatttttattgtagaattcttctttttagtagaaaataatctctaataaaggagagagaattattattgtttaaaattattgatcttgaccttttttcttcttcggttttttctaagcgcacaactgtacacacgacacaatgatgtgaaatcttgatcattaaaaattaataaagtgaaaatatttaaagtttgaaaataaagaaatgattattaaaagttgagattaaaaacttggagaaactccattggaggggatcttttctcaaataaacacttgtcttgatctattttttattcatttaattacatatttttcaatttttttttagtaaaaaggatattaaagggaaggtaatctataaaataattaatgtaaattttttatttttcatataaaactaactttttttatcttccttaatcttattgtcaagtttctttttaggaaaatatatttttgtcaagttattggatgtttttacatttgttagttttgaccgtttatacgattattttggaataatttttaaacaaatttctctatattcacattgtgttttttccatcaattttcctatgtctcggtttgtttttactaataagagagaaaaaaattatttcaaatgttgtgacaaaataattatataaatatcattactatataatgaatccgaattgtttcttatttttttcttcttcttttcaaaatcgtattattatgatgttgactttgggtctatgtggttcattagtaatattaatattaatagtttcttgcctccaagtgtgttctgttgtcccgtcaattgaaatttcttgctcccttctatgtcctttagaagcttcactgaagaagatcccaagtttggtaaagagttatacattagttttagtaatcttcttgttcacagtttgtcaaaaaaaaacaaagagttccttcttgttcacattttccttttctttttgcaaagtattcaaaatgttaacaaaatattcaatttagtacacctgattagtgatttcatgagtacattgggtgatatattggaaatatttcaggatttatatgaatgaatgtatattttctaaaattcttgaatcacgtgatcgaccttcttgaaggtgtatgaaagtgcatatatggtattgaatattgatagttttggaagcaaagcgtaatctttcttgtgttttaacttgagctagggacggattcaaatataatgtgacggttagggtttcatagaatactaatagatcaatattataaaatgttatgagagaatatataataaatcgaatggactctaatttattaatattaaggcctaatagtttaagtacaatactttattatctaacacataccttcaaattcatgatgcatcaacaaaaacattgtgagtttgtcaaacaaaatacggaaaacataatattatataaagttctaatactacctctcaagctgaagcttacggagctttaagtttgttacaaattaacccagaaaaatcaaccaaatcagctgttagcaaaaccaatggagagcagcaatcaaagtgagttatcttcgtagagagagcagcaagaacaatcaaatcatcaagacaaaagaacaggtagagagaagcagtcatacaaaagaaccaatagaggagcaaccaaagaatcatcaaaagtggaagaagtgcaatcagaagaagaatatcaaaagtggggagcaatgcaatcaatcagaagaatcaacagagggagagtgtaatcaatcccaagaatcaaaagggggagaagaaaccaaattgtgagcactcgactcactaaacaatcaaatgtgagaactagactcaccaaacaaccaaattgaataatcaaaagggggagaagaaaccaaattgtgtgcactagactcaccaaacaaccaaatgtgagaattagactcaccaaacaaccaaattgaagaatcaaaagggcgagaagaaaccaaattgtgagcactagactcaccaaacaaccaaagtgtgagcgcttactcaccaaacaaacaacatgtgagcactagactcaccaaacaaccaaaatatgagtactcgactcaccaaacaaacaaattatgagcactcgacccaccaaacaaacaaattatgagcacttgacccaccaaacaaacaaacaaaccaattttgagaactatcttgactcacctaacaaccaaacaaatttaatcaaacgaaaccaaatcaaactgaaccaaaccaaacgagccaagcgaaaacaaattgatgaacccatatgaaccaaaccaaaagaaaaatagagacaaggagaaagttgaactcaaacacggctcatgctagggtgggagagcttgataggtctcccaccgtgagcaagtgaaaaatataacttttgacggtcatatattaaaattctatgactgttaacatacaccaacaacacggatactttttaattctcactttgttctctcttctccatcttcaaccttctttctctgtttctcacccaaaaattcagattggcagcaacatgagtttcaaatagagttgacatataagcttggtcgaacacctcttccgttgatatgaagctctaccattgaaaccaatatatttttcttcgaaataccaacgtgtttccatgaaagagtaatgagataaattttttaaaaaaacttaatgaatttatttaactagtttaagtgtgaaagattcaagttttaatattttaaaaaagaacaaaaataaaatttagtgacaaaattttgatttttcgaaagcttcacacatctttcaaacctctcaaccaccttttggggcttttaggaaccgcaagcaaacaccatttttattttttgccgaagatgcaagcaaattattgaacaagcagaaaatccattgtttggatattaataaaggaacacaagttaattagttagcttatttatttttttcttttacaatttcctttcattatattaatcttgaaccgggacaatccccttcctttgttttctaattccttgtcaatttttgcaattgattatggattgattatcgcaaggagagagaaagatttgttctcgaaaacgaaagtagttgaaggagaaagaaaagagtgagaatggaaattgatgaggtgttggtagtgcatcataacaatcttgaaagcttacaatctaacagttaataatattctctcatcgtgagagacctatcaaggtcgctcacctcagaaggcgccctcaaacaccacaaaagccataaaaacatctcaagactctaacttcccacttacagagaactagactcaaacaaataaaccaaataaatgagattggtccgaacacaaaactcaaacaaaaaaaaaggagaaacgaacaacgaaaagacaatactcatgagacatcacaaattttttcttttcggtctgatgatcttgcaacaatattagagaaatttgtgaggtaccaaatcaaatctcaaagttgctttacaactctttgcaaacagtggttctacggagaaaccacccagactcacatttccaagtaagacaaaccaaaagaaaatagccaagactcatgggattccaaaacaatggcttataggtaccattatcgaacaaaatgaaaacccactcaataatatccaaatcggtggctttgaaacaataacctctttatagaaaacaaacaaatgccatgcgagttcaacatatcaccgaagcaaacaaaaatggtgtcgaataactctacaccaatagcactcaaaattcaaactaagacctaacgattgaaatcaaaagttgaccaactaattaaattagcgtaacctaggaagaagaaacaaaccggaattgtaacgtgcaaactgaattgatcatcaaataccagaacaaatatattcccaaacttttgggattcgacagcggaagcgactagtggttcaagacgatcaaaccatactcttgatactgaattatgaaagaaattatgaactaaatcatactaaaaataagaaataataatgtttgtctctacaaaacagaaaaattaagagacaatatgtcatagaaaaactctgaattttgcctaatacttactatttttgcttgcaaggtgagaaaaatttgtttgagatctgcaccatatatgaatttatgatgcacttccatgacataagtagcactgcagcaaagtggcctatgattttatacatcaatttatagttctaggttcgattacttgatcataaattttatgattaactcttttaaattaatactttaaaataatgaaggaaaacgggcacaatgggagagacctagtatactaaaaaaaattgggtaacaatcatgtcatgtgtggctatagccacataaccctgtagtggatccgtccctgacttgagcactgtaggctaattagagtttaattgcgattagtattatccttttctgttgcgtgtttgagattggctataaataagcctcccttgtatcattagcgaatgaatgaaatcaatatttcagaatacatcgagttcaatttttaggtggaacaattatctatcaaattttacttgtgtttcgactaaacattaaattattaatgccatttttcgaagtaaaccaaagggttaacaaaaaaatccaaacgaatccaaaattccaaatcataaccgccaactgaaccgaaaatggtagaaaatcaaatattattattagatgcatttggatatcatttttgtaaaccgcatttcttatcactttttttgaaactaaattaattcgcataagtaaattttaatacttatttattttattagtataatacattgaattatactgtttattggtttttatttcttttaaaacaatacttattagtgtaatttagtctattgtttatattacttcatatatttcaaacataatcgatcattttcattctgcaatattaatttatgatatatttcatattatactttctatgaaacatatcacttttgtgtaatattaatactaataaaaaattataattgtattttgatataaaaaaatcaatccaaatacaacataattggatggtttttttttagtgtcattcaaatcgaactgaacaatgcatgattatttattttttagatcggatgatttttttacctcaaagtcgatctaaaccccatcacacacaccctacttgcatccaacaaatcagaaaaaactgttaactagttgaataaagaaatctagactcaacatcattgaatttaagtgttacaaccaatagttcttataacaggaatagtatgatttcttaaacttggccatgaactacgtgaattcatggcgatgatgtgaattagctgcatgttaatatcatcgcatgcatccctttcagtttccatatctaagggaggtacaataactataggttttgttactccatataactcttcaactcgtactttgttgcggcttagattgcatggtgattttcatcggagaggattgtgctagaatgagtctcttcgtcgctattgctaagcgattagagagatgtcacaattgttttattattatttattagttctgatttggactttttttctttctacgcaaaaattgacacacagaaacgtttgtgtggtaacaaactcaaattaaaattacttacaaagagtaaatgaaaaaagataaatttcatatttttcaaggtgaataagtaaggttgtccgcggttcgaatctgaactcctgcatataacaatatatgtcactgccaactaagttatgcttacgggaaataattgaattaattaataggagaaatgctaacaaatcttcttagtgtacttgttgagaagtttaaagtgaaaattttatcttaaaaatcatgaaaatcattgaaacattaaaaaccaaatttttcaacataaaacttatcaattatctccttttctaaatctttaacaattgtcctaaggaaatttgttagcatgatccaataaataatactttttacttttgtatgtgtgccataaacccctaagtcatttgttagtatcattcatcaaataatactccttttacttttgtcggtatgcccataaacaattttgatttggtttggtaatcatacaaacatttagctcgtatttagaaggattaaaataaaaagttgacatatttagaaggagcaaaaatatatttaacccttaattagcaatcactttgtcttcatgatcacttgttaattcagttcgttcatttaacttttttaatttatgattgttttttgtattactggagaaaatatctacttcttctaattaagaggagatcgatcacataaatgaatattgcaatggaaatttagaagcaaatattattcaagaagcagatgaacttaaggttgggatgtcattttgttctgaagaagttataaaatattgaaagtattatgcttgatgtatgggttttggaattggtaaaatcaattaaaagaatgcaaatgatggaaaaaaaaaaaaaaaaaaaaatactttgctcttgcatgtagtcgtgcaagaagctatttgattaactcagaattttttgaagtcagattcaatcataagttcacaatgtaaggctagagtaaatgtgcttgtgtgtctttagatggaataataacaatcttaagcattgctcattcgcataatcataaattaaacacaaccagttcaaggtatttaagatgaatgatttcattgaatacaacaattacttgtataagtcttttttggcttggagtcctaattccaaaaggcatttaccaatgcaaaattgaaaggatttcaaattgaaattgcttctatgatgtactacaatgctttgttagctcagcttaatttctttttggctttcattccttgttttttttaggccggctttcatttcattttatcaggcttgtacgtttggctcattttcttctatgttagcttaattttgttcatgtctgttttttactttataattgagttgcaattttgaattgttgatgcatatatgatatatttgacaaaatcgcatttcgatgatgttgtcttatgctatttaaatatttatcctttggcacacaattagtacttagtatttagtgttagtcataaaagagtctccctcatttgggattaactcatctttcaaattaacctttatttttcttacatctgaaaccgtttaatgtaaactttgaaatagtaattactttttaattggagtgtagtttggtttgaaactaagaatacattttttttctcactttccttttgcaattgtatgtattcactttcgtcttacctgattagtgattacatacaacattagttcctaatgtggccaaaacaatacagttaacaagtcagttataagaatcctaaaagataactccaaatttttttgcatattacgagtacactgggtgattgaaaactctaagtttgtacatatttttcttgagactattgaaatttcatacttcaaatgttgcataaaatggtaaaaaagtaacaatacaaaatggtaaaaaactaacaacacaaatttacaaaaaatggagcctatgctgcatagcactgcatgtgaccaacaccatcaatatcacttatgtgctctttcaatccaacggctacactttcacactttctcactccatccaacgcttctgatttctcggacatttccatcaacgaaactcttctattcttcttcttcttctgcaccaccgcttccagacccaccggtgccggagcaggagcctccgcctcggaatatccctccggtggaaaagatatacctgaatcagaatgttgtggagacaaaacgggcgcagcagaaggagcggtaccgaaattcaccgaagaatgaacgtgaatccttccaatttccggcgattgcgctggttccggtgctggtggttttaccggagcttcaaccgcatgactagagccgccgccttgccttcctgtaacattgaacgaaaccgatcttggaaccggatcaagaaccgtttgattttgcttttccggcgaatgcggaatccttcttggagtgaaatgacggtgatctggtgaatgaatcggatttaccggcgccggcgccggagaagtgaaatcaaccgatctaacattaagaattccagcaagaccgtgcacagtaacatgacgaccgtaaaataatcccggaaaagcaacttccacaccgccaacagtcgtaacagaagaagaaccagatcggcgcgtgaacgaaatacggcgcgtggataacatcgtagggagcgtgtaaccgttaggaagaagacgaagctcagaaagagtgagacggcgtggaatgatatgataacggagagtatcggtgtaagacgacgcagtttgcgtcatgtcgagagcgaagagtgaagaatcagtgggagcgaagaaagtgaaagagtttgtggcgtttgaatttggatcaagaagatcgattcgaagatcggaggtgaggattgcattgcagaagaggtggtaaccgcgtgatcggagagtgttgagcattgaatcgaattctctgttggggattgaattcaccaccgtgacggcgttagcaacaagaagaagaagcaccataagaggaaaaatcgaactcattttttcaagatttcttcacgcacaagaaagatgaacaagattgaaactgttactgttactttcttctttttgcgggatgggttttttctttgaagttttactttgacggttttttctgttatatttattggaaatttcaacctttcttattgttgggcttgggctttcctttttgggttacttctatcttcatgggcttctgttacataatcaaacttgcgaagaaagacgagagatgctaaattggtgtgggtcccacgcttttgcttttcccttcaaactttcgaagaaagacgagagaagttctacttttcatttcattttttttttccttttttacccttaccttctacatcaactatggatggcaacatcaaaattaaaacttatattatccatttgctacataatcagatctataatccatttccttttctttgatacatggcaggtatcataatcatatctatatatcaaagagtgaattgatttttttttaaaatagccaaaatttattccaatagcaaaaacatcacaagctgagatgttgtgcttggcaaaagccacaagtacacaggaacagaagaaacacaggcaaggctgaaaaattaacgcctaagccccacactagcaatcacaaaatacataaaagctgcttcgtacaaggacaaatagtaagtatttgaaaattttcatctctattcacttccctgctatcttgtttcatctaataaaaaatggaaaaagtccctaaaagctgcttcgtttgcatgtggttggtagcttgactcgtgatattaattcacgtgcacatcacaatcttgatcacattgcgtgcaaggccaagtcaagatcctcatttcttttcttcttcttttgagtttttgactcggacatattttattcaagtattttgtgtgtggaattggttctctaacacgagcatttgttttacatgaattttatacaaatgagttgaacgtgagattttgttttttgagggggaatgtgagattatttatattttgatttagttatgaacatataatcactatattttgagctaaaaattacaacgataaattccaacaataacttataattcattctaatgattttaactttatctctttcgattttagtgaaggcatggtgtcttaatctccttttgtttatgtttatgaatagtgttgtttgaatttcatacgtactctcaaatcttctctcttttaaaacatatgttgcatttttataatgtatattatttacataatttattttggctccatctttttagcttacatataaatatgaatgtcagtatgtaagatgttgtttgatttatatataattctatgacatgtattttaaaaccgagcgagtaaatgatagtcgagtatagcaccttaattttttttccaacaaaattaaatttaaacttgcaataattgatcaaactcgatacttttatggccctgttttcatgattatgcccaaagcccgcaaatgtgacgaagcttgcctttatacatacataatttttttttgcggtggacgagttttgaacacaaaactttacatatattatacatcgtccctatcaacttaaccaatgccatgaggatatacatacataatatatacagttacctacatatttctcactattccaccaatatttaaactctcaacctttatatttgagcatcatttattctaaaggatgttgaatgaattttgggtgtacaaaaataattcctcttaaacttttgacaaaaacttaaggtaataacacataatgtatgaaaaaaatgacttaccatgacttaaggtaacaattcaaaaataaattagtgtgatgtcgtagtcgccaccgccaccgccatgcagcaaataaaagcatttattaattcggtgaagcaatgtctgagattttataaagagtggtatcaatgatcaagtaaaacacaacacaaaacaaaacaaaacaaagcaaagaaaaaatggtgaaacagaactcaaacaatagcaacaactgcgagatcataaaacttgaaaccttaaacacaatagtcataaaaccctccaaacccacaccaccacaccttaaaaccttcaaactctctttactcgaccaactttcacccaatatccatggcaacaccactttcttctacccaaaccattcttctgattcttctttctcccgaaaatcaaaacttcttcataactcactctcacaaacactatcccttttttaccctctagccggacgtgtccaagacgccaccaccattaactgcaccgacgatggcgttttcttcatcgaatcacaaaccaccagcaatctctccgatatcctcacaaaccctaatttcaacacgcttgaatgcttcctcccaactacccaagaaaaacaaaacatgctcttagtaatccgtttcactttgttcagttgtggttccaccgcaattaccgtgtcccttacacataagatcgttgactttaacacactcatcacattcctaaccacttggaccgtcgtctgcggcggaacacaaccggtttcactcccggacttaaccactgcagccactctctttccggcgagagaaattcctggtatgtctgcttccattaaaacttcaaccaaaatattcacttctagaagattcattttcgaagcttcgaaaatagaagaactcaagagaaaaatcaaaagcaaaatagaatgccaaaacgagcttcagtttcatccttctagggttgaagttgttctagctctcatttggaaatgtgctctttcagcatcttctcgttcaaaaacgacgtcgtttaagcagcgttcgatattgttccaagcagtgaacctccgtccaagaatggaccccaccattccagaaaccgccgtcggaaacttggtgtggccgtttgcggtgacggtagaagaagagagccatgtagcgttgcatgagatggtgaaaagaatgaggaagggtataatggaatttatagaaaagaaagcagagaagtttaaagaggaaggtgggtttaaagtggtgatggagagtttgaaagagagggttgagattttgaaagggaataataagaatgagaatgaggagggtagtttggtaatttacaaatgttcgagttggtgtaaatttccattgcttgagtttgactttgagtggggaaagcctgtgtggagttgcagtgtgaataatttggtgagtaatacgattgctttgatggatacaaaagatggtggtggagttgaagcttttgttactcttgatgaggatgagatggggttttttgaacaagatcaagagttgctacaatatgctttgcttaatcctacaattatcatttgaattcaagcacttctcatgctgccataatgttttatattatccatatccatttggagaaacaatcatatatatgtttttcaaagatcccttagaatatatatatatatatcatatatatgtttcataaaaaagtaacaaccatttatgtaaaatatatttcaaagcatttttggttaataaatttatgtcttttttgtaagagatggtttgaccttttagttaataaatttatttattattccatttggaagcattctacttgataaattaacataagacaaaaaaatcgataagtaattcatttttactgcatagtggactatactgttccatataacacttatccaactcataatatttttatggtgaatatttaagcaattcataaggtaccatcgcttaattaattcctttggttgttgattgcatatatgtcctccaataagatactatgtaattttttatggaactcaaattgttacatagatgtcctccaatgaaaacaaaattatggaatccctatatagttagggatggacatatgaacaaagtttcggtgtgactaaacaaataacaattgattgttaaaattttactattttcgttgctaatcaagtttatggatatatatgaactcttactttaccaccaaaaaaagaaacttttattttacatatctcctttaaatataagagtagattatatggtgtagtgtttgacttatgactatgttctgtttgaatcttggttggtaaaaactaaggagaattaaatttacccttctcgagtttaagtatagaatgtgcaatgctatttgcggctaaaggaaataatcacaagttttacgaattgttaaaaaagggaaaatatttttgtccgaatttgtggccaacattttcttatacgaacacaaaaagaagtaaaataacataattactgagtagttaattcactaattgaactaatttgatgcttgaacacatgctgcatgattaatgaattgttctcgaagccatgatcatccacattacattttttttctttctttcacaaaacagtgagagagtatataatatggtcacacttttacaccacgcattgaaattctatagcttccacgttgttgtcatgcttctcttttgcatcttcctcacctactttctttacttgaaattgttggttaatcacgtcttcaatactctctttattttcatccaaaggaattggaaacacttctgaagaccctaacgggttcacaacaacaatgtttatcactgcttgctccttctccttctcaacactatatttcgagtaatagccatataacaccatctgaattattcccaatatgaacccaactacatttgggagctgccaaaaaaaagtgttaattaataattagtatacaactatacatagctgatgataattgtaatcatttttaataaattaatttaatttaatacattatatacttacataaatgcaaatatcccttttaacaaaaccgtatagaaaccatactacggcacttaatgtaagaaaaagtgacaaattgaagggcataaattctacactctttgttttaacgacccgtacctacacatagataataaattatgagtttgacaaaagttattgatatagaaattaattagttgaaattgaaattgaaattatatatacttgacttaccacaatgcttaatggtgctgcaaagacactaattgatatggatgtacaaatccatccaaggacttgaacacggtggttttcaggtatagaaaattgtatgatcaagaagatcaagacaaatgaaaccacatttaacgcagcacaaagtttgatggttaatttctgcaattaaaaacaaattaaacatttttttcttcaataaatagaataaaacaacttaattttgtaacacatatttttaatcaataaatagaatttataatatttaccctggcatccttggttgcataagctatgtacatgatacagtagataatctctatgacacatccaaatgcatttatcgaaacaatgaaaattgcatttgtttgaattccatagtatagccaaagcattgaactgaataatgctaccaagtatggtagtgattggaaacattccgtgcttttctttttgtatatttggataaaagtaggcctgcaataatatatatatacacatttacgccaacgaaaaaaaaaatatagttagttcagttttttatatatttaatttaataaacttataataaaaatcggcatgatttaataatatatattctgtttaaatttacttacagaggagccaagtacaccatgcaggaaattatgttacctgcaaatcaaaagaaaaatatgttgatttgttagtttttttaaataaaaaaattgttataattgaaactataggttgcaaaatcgacaaaacaatcgttagagtgtgaaaaagaattttcaacaactatatatgaagttggaatttgtgatcaacccatacgtcaactataattcataatcatagcaagggggctatcacctattcactacttccaaaagatggaaaataaaagaaaaaaaatacgtactataggaactttagttggaaattaagatagtacaaaatatgaaaaatcatatatgagcaagaaaattgaaaaggaaaagaaaaaggtataatccaaacacattttgctgaatcaagaaagaaggaaagaaagaaagaaagaaagaaaacgttacctagtaagccaaaagcaatgactaaaaaatggtggttcatcgaaatcatagccatgattttcttcttcgttttcttctcaagattttgatctagcagaagaaaatagctagcacaaggtttctttggggttgggacttgggaagagaaaaccttataggttggtttttcttccaaagcaaccccttaatgtgatgtaggtactgaatgaagatttgttgagcaactcttgctatttatacacattcgaacactgagtgagaaaggttaataaaaagatgaaaaatgaagaaataatttttttaaaaaaaagggaaccaaaaacagaaaaaaatggaacaagtatgtattgttatgttattattagtgaatgtgctatgtgacattcatgtgtaattgagtcattcagggttcatgaagggtttattcattttagtaggtagcgtgccacaaaaccatttcccttcccaattcccttgaattattgcctacgtggcacatcaattatgtataaagtgacaaaaaaatttgggacctatatatatgtcatcaaaaaaattaattaacccaattgcatgaaactcataagaaactaacacgtggtaaaaaattgtgtgtggtagatctagtttaggggagtttttttatcttttttaccttatagtttagtttaaccacttgagttaatctattaatgtttaaaatttgtaacttcaaagtgttatcacaatattgttaagtttgatcaactgatgtcgactttagtaagttagtccgaataaaactttgatttaatattaaatgaggttatcgcaagtggttggtgagattagatcaatcaaattagttgatttttatcgagttttttaaagaagtttaatatatacaaagctaatttaaaattcagatttattacaaatgattgaatgataagtggattcacctctaattttggagtaaaatgtcttttttttagaacaatcatgaattgtattgaaatattgtttcttatcgcgtctccaattgatatatagtttctggttatatatttggcgaacactctagtgccctatcattcaataattataatcaagttctttttccgtaattaagttattaaaaaaaataaaaataaattgtcagcatgtaccagtgtccaataaaactgagatatggaagaatttttactatttacgatcggaaatacgcatagtagctatgggctaaagaagtcttagacaagggtataaatacttgggattaataaaattttcttcaatttggaaagaaatttaattttacattccaaaaagatatgtggaaggtatgtagaagaaggtaggggcaagggtagattcacataacatttcaaaacgatacccttccctatagtttgttgtttgtatgagatgaatgatggatgaattgcatctagtgacaaatttcaattaaaaatgccaatgccaatgccatgctgaatcgtacgtacacacacattctttgccgttctggtgttgaattgtgtcatattgtgtgagctagctgtttttatgtccaaattgaaggtttttcatgtgtaagaggcacaactccctctttgcctattcattcctttccttgcagtacaagtacattatgcatgcaatcaatgatttttggtcttattttagttttctacaatcaagtacctacctagataagtccaaagtaagacattaattttgctgtcgtattcattcaattcagtttctcgatgattgggatgatcgattacttgagcttgtgaacaattttcattttccaattcaattcaaggatatggtggtagtatgtgatgaatgatgatgaatgcctaacctctaacatggtcaaatttgcattaaatacaggcttaataattgtatatatttttggttcctattgttttcaattgcttatatcaagttttcattcattttgtaaccaaaaaaaaaaaagttttcattcattttcaatcaagaaaatacttaatacttctttagaacaccttgtgctaaagaggcgtctttgatagtgtgaatatataccatttttgctttttcaaaaaaaaaaaaatactcaatactccataaagtaatattttactcaagtgtcaacaaaaagattttttaaacaatcactacaaaaacatggtactccctccaacgcaaaatgattcaccttgttttttttttttaaggattgattcaccttgttgacggttttagatttggtgatgtacaattttgatatttaatatccctaaaagaaaaattgacatttaatatctttatttatttaccaacaatattataaaaatctaagggggtgtattggattaggattttaaaagaaaatttttgtatgaaaaagtctaatgaattttaaaagattatgcaagatttgaatgacttttaagattttaattgtgtttatgaatatttaataaaaatactatcaagattaaaagactatcaagatttccaaggatttatattaagaagttaattgtgtttatcttagatgcttatgtgatttttttccttcttttccaacaccgtgtagtacactattaattcgtttctaacatataatagactttgaagacaagtattacatttttttttttaagaatgcaaagatttattacatattaaaaatggttctatacatagagtcatcttaacaaaatagtttgaagtagaactaataaattgaaccaataactaaaaaatttacaagaatgaaattataggaagcctcacaatccactaacatcattcaagtgaaggtagttctaactaactatatatagatcggaagttttctaatcccataacaaagtaacaaacgaccttactctatgcaactcaaaactaatgagaaaatagaatttcgttagatggcacaaaaaataaaattgtgagattattgaatgagtactgtaatcacatttttaactaaaaaatttcacaaaatttactccatagtattagtcaatcattgcttgtgacaaataacggtgatctataaaactctataatttagattccatcagaccaacacacattttcattggacctgtgcttcgacgatcaagttatatgtgtactgcttcaacgtttgttgattgcatttaattgatgaaaaagattagtagtatgtttctcatggtatatgaaaaattgaaaaaataaatcaaaatttaattccatggtaaattggaaataaaaactttaattataatattttcggatcttgtatatattatattatacattgttcttatcaactgagataaatttatagggattgttttgtggtctttgttcgactgatacaattacaatcaaattgaatgattgataatcaatgaaatataaagtgataaagaaaaataattttttttcaaaaaaatagtgataaagaaaaacaatttaaaaataataaatgggttgaaccatttgcgaatctaaatcacatcggatatggaaaatgatcattctagttatcccctaatattatcactctctatatatttccgttaaattacaagttatatttccgttaaattacaaacataaagttcacgttctcacaatctttgacctttcaagtgatttatctctccaacatcttctaccataacaaaccaagcacaatatgctctaaatttccatgagtctaaaacaaagcttcaccttgcatttgaagcgtacaagccaatttacacacaaaaaaaaaaatactaaaacatatcaaaaacatacttagttgatgagcatgattaactacaagtcaattcagttttaattttgattttatgtttggaaaaaggggtttaaagggaccttaaatttgattttcttttttgagtgaaaattgatattgattaccggagtttaaagaagataaaattgggaatgaatagcaagaaaaagaaaaagaaaacaaaaataggaagagatatgttatactagctttctagtgtaaataaaaaaaaaaaatttgaagaggaacacactctcaccgcaaaactatttgtatccatcgttaaataatttgaattaatgttttcagacttaattggctatatatctacagattgctattttgacgggtgttttcttaacttaaccagatggttagttgagagaggttactgcattttttaaactcttaggaggggttaattttattttcccttaattaaactaattagatactaacataaatgttaatgtcctcttgaaagaaaaatcacatgactaccttcaggcttcagtgcaagaaaaagttacaaatataagagtgttaatcaaaatattttatatttaataatgcatactaccgagtgttcataccgtgcatgtgtgggatggttgggggtacaatttggcaaaccaattgaaaataccaacttcaaacttccaggagtgggcaccataattgctttcaacaaagaatcctgctcttctcccattactcccacccaaccaaactgatcaaaatatccctacattagttaactaacgcatgtgtaaaattctgtgttagttaacgcacacagcgtgacttaaatcatacaaatataaaacattgcgtaagttaactcacactaatgttaatctctataccataattatattattttcctctgcttctaatcaataccagaatttaaaaggaaggtacaagatctaagttgctatacagctccttaccaaataataatgaagaatctagtaattctcatttaactttttcactactgatggtgtttgacttttacgtccaaggaaggcaaaagagtattattatagagttggaaaggcatgtgcataaagtccaatacatgtgcataaagtcaagacgaaggcagagatgaagaagaagatgtgaatggttttttgttttagagtgacttaagtcacttaattcacatagaaatataattatcaatttcgttagccgcgagtgttttgtgttaagagaagagcagaattcttcaacaaatggatctccaaggtgatgaagttgagagagtgcaccataatctaaatccaaattgtagggtagcctgcaattgttttttaataaattaaatagacttttcataaattaaagcaaatattgtcaaacctaaatgatactatgtccttttagttaaacccatttgggttggcttgagatcttggagtttgctcctccagaggtctcaggttcgtttccctctagtaccaatttcggtgggctaagtccatacagagtttgctctggctttaaacggtgtccccgaaagtgaacggtggaattgttcccctcgaattagtcgattcttggaccgaataccgaattttcaaacaaaaaaaaaactatgtcctttcagttatatgttccatgtatctatccaatacacttttccatatgagccgcattatcctcctcggtaatctcatcatctcctgccggctccgcacttcagaacttcccacaactattcatcttctttattctcctccattgttctgaaaaaaaaattaatctaaaaaaaatataaaaaataataattttcttcttaattaatttcattcttattaaaataaatctagaaaaaataataaacataattttttgtatattcatcttcttcatcatcatgatcatcttattcttcaaagttcaaatccataaaaataggaaatatatacctcatttgaatctgacctaaccacagtagtctcaaactcaatatgttaaaagataaaagattaattatacataatatagcattaaatgttaattatatcatacctcatttgtagttgctaccgtctgcccataccgagaatagtaaagtaaaaaccaatctgaatggcccccccaacgtgaatccaatcatattgggaaccaggaaaaaaattaaacatttaacaaataaatgtataaagaattattataataattttttattaattaaattaaataaatactatagatgctaatgttgttgagcatgaacccatatcactgaacttccgataagggagagtaatagagtctattgcttggacttcatattatgtgtatgaaccacatgtatctacaaaatattgatgcatacagttaatgaaaaatttgtaatattaaaatttataaaaattagtatagaaaagtttacttaccataacactcagcggagccgcaaagtgtaacaccctatattttgactatcaattttaatatttttattaattggtcaattatttgtttaataatttattttaagcttattattattcattaagtaatactttcatatatgtcttttattgcacgttgatgccgtggtataatgagtaatacttggtcaaattgaacgggtctagttagtggttagttatgtataccatgatttaagctatatcacacagtgactaacccctataaacttgattttccttatttttctttagaataacctattccttattttcttcggtatctatgatttccactactcctttatttccattactctctcccctggtatgtttcaacgtaaagatagttcacacatcactatctctcaattttccgatgtctctaaacacatatatataacagtataacacgccatattccctctctcataatttgatttacatgtcacggtttggtctccataatccttctttaatgattccaaacaaaatctgatttttctccctttcatttaaggaaaataattactttctcctctcttcctgcacgttttaattttacaaacattatcaaggaaagctcttcaatgttgttattccattaccatgcatctctggtcttcaaggaatcatcaacaacaattccaccttgttgccttaaccccatactataatttgaataggagaatggtcctttcccatttttggtacatgcacgtcccctcttttctttgacatatgaatacaatcccttcttcatccatattattttgaggatccatccagcaaccaccttcttaaaattcatggaagcctaaggtactctaggtcctatttatcttgtttccttccatgctccaaatctctaatcctagagttattgttttattgaagttattttcgttttgtttagacctgccaccgtagaattgcgactgcgtcttcgttcaccattttgattggactaacttttgggcagtaccgtaactgagaatttaatcgtgatttaggaaggaagcgttcgaggtaagggctttttcccataagttcttactaagtgctagtactttgttattaaacaggggtagcaattcttgtcttttgaaaagaagaaaacaattaaaatatttatttacatggtaaagtctaatattttataagagtgattattttaattgagttttatatgatagttgtgtatgatgtgatgcggaatgatattggtattttattttattatgtttatatgtttttgtgatgttgagaaagacatgttagattttgattaaaagagatgaaaatatgagattattgaaaagattgtttatgatcatgttcatggtgatgtgagatatataattatttctgtgtggtgcctttgtttatgatcatgttagtttatgatcatgttcatggtgatgtgagattgtttatgaatgaattgtaattgtgtgatgaatgtgattggattatgtgtatctaatgtggaatttgaatctctgattcatttgatctctcaacataaatatttacctcatttaattgttttgattggcttatttctatcaaaaaagatagtacatgctaataaaaccatgagaaatcacatggtttcatattaagtcacttaaacagggacttaaattcttacacgagactcttacagacacgccaatcaattataactattggttcctttaaaaacatttgacttcaatccgtacacctttttattaatatattcttcatcaaatcacatttgattaatttatttgtcattccagagatctactctcataatttttgcaggtacgaatgtgggtacaactgtattgatcgttttaatcatacatcatacatttgattgtacctaattcctatagtgtgagtgcgcgcacacgcacgcacgcgcgagttggtgcttttcgcatgaacactctgtgtgcattattaaatatgatatattttgattaacactcttgtgtttggcttcttcaatgctgaacattaacatttttgtagtatcttttttttttttaaggaaacatttttgtagtatctaattagttaaattaatcatttaaaataattacaattatcaaatatatctatatatatacacacatacatatttatttattaatatatatatatatatatatatatatatatatatatattgtgtttggatttgtattgggggataactcagatgataatatatggatactattctaaatatagcgttgcggaaaatgatacgcaaatagaacacacttagttataaatgagaattgtaaaagaatcaagtaaccaagaagttgttacagacactggcggatcttgccgaaaatattggggggagcggtaaatatgaactaaatattataattgaaattcataaaagttatataaatttcatccaaaaaatatcaccgcaatagctcaaacacgagactaaagctccaaatatactatataccaactagagagataacatatcttaaacttagaggatcaaaacgagtcagatgcttgccacgtgcataatagaaaaacaatcgcacgagactggtacatatatataaacataggagacatttacctcaatttaaaatttaacggttcggtcttttttagacttgaactcgtcaataattgaatcagtactaaattggtcaactatttctttttcaatataaagcatcataccgtcagcaagaaattcatcctccatcttgttacgcaatcttgtcttgattaacttcattgttgaaaatgatctttctgtagtagctgtagaaaccagaagagttaagataaggcggattaaacgatcaaccaagtaatgtgtatccgccttccctgtcgttttgagagcttcacacaattcagacatagttgacaacttattcaaacctggatgactaacaacatcaagatggaagtaatgaagatgatatctcaaactttttttgtcttgctcaccgaaatctaatggataaaatttatgtacaagagcacatatattatctatatcaaatgctttgtaaacatccttaggaaccaaactattgcttagaattaaaagctccattgtttccggacaaaacctgtgattcaattcctgcaattgttgatcaattgtaacacaaaagagattcactctaaaatgctgacccactgtgatgtgatccatttgatgacgagcgcgaccttcacgctctatgtaaacagcattacaatcaggggaataaatgtcgtgtttttcacaaaataatattacatttttcaacaaatcacccgaccatcatctctcaacttctgaattaatgtttttgtatagctgactaattgcatagcattaagtatatctttggatttctgttgcaaagcttgacaaagacgatctgtaattcccataatctctttcatgatgtgcaaaatcaatgtgaactcaaatgatttcaaaagtttataagcaacattagcatccccacgcgtagtataacttgatccagtcttcctaatttcttgaagaactacacaagttggattatgcagatttatcatactacaaatagaaccaaaatttgagctccaacgagtatctccagttcgtttatgattgcttttctgattttgtcctttaccactctcaatttcaccaatctctagcaaattaataatctcagctgatatggccttttgcaattcatcattacgcttagtagaggaacatgcaacattgacaatgaaagtcaagtgagaaaaaaaatcatgaatagcgaaaacttctctagacgcagcaaccaaagcaagttgtagtctatgtgcaaaacaatgaatgtaataatcataaggacaatctttaagaaataatgcttgcaatccattccattctcccctcgtattactagcaccatcatacccttgcctgcggatatctgaaacattaagaccatgcatagaaagaacatcacaaacttcttttttaagtgtgatagccatggtgtcatctacatgcacaagctcaaaaaatcgttcttgtatgcaaccatgtttatccacaaacctcaaaataatagccatttgctccctaagagattcatcacacgatttgtcaacaattatgcaaaatttagaatctccaatctcttcccgaatgtagtgtttcactttacaagacatgatttgcaaaagttccttttgaactgcatgagatgtatactttccgttatatggagcattctctagcactactttagcaagttcatcattgtatgatgctaacagtttaaccatttcaagaaagttacctctattttttgaactaggtttttcgtcatggcctctaaaagcacaagcttgaaaagtgaggcaacaaactgaatcaatagagcacctgagacgaagtctattatggaggatttgctcggaactttgctcattaagtgcaaatctgatgttcatagattgattgaacaagtcttgagaagctttcactgcattattgtgagatgaacaaggactctctccaatatgtttaagaaaaacacaacactttccagaattgatttttctccatgctttaaatccttttctagtaaagacgtcagctgtaggattcccatttggtttttcagtagacaagtaacaaagcaaacaataagcagcatcatttgttggagagtactctagccatgaagggaacattttgaaccaagatgcttgaaatcgtcttggatgcttatcttcattaagaggatatttttcagctacccattgataaggacatcaattaagataagctctacgaacttcatctctttgattcaccggatattcccaaatttggaggcgcttcccggggtcatgttctaaacgattgacatcaaagttctctacaatgactctttgaatcttgcaaggctgctcgtccggttgaactgtttgatcaccggaagggctctgttcgagatttgatgttgaagttatacaatttgcatcttcctcagggacaggaagtattcttgtataaaatgcttcaagtttcttatgtctgactttcctcatactcctacaaaatgcacaattcacacataaattacaagtaacaaaatcaaactagaaatggtgaatatgaacaatgacttgagcatgtaattaaaaaaaaaaaaacattatcaaagaacacaaaacaaagagtaataatcagtacagtacatattcatgtcttgttcaaaatatgaattaagccactatgtcctaagttctaaaaatagaattgaattgaatcagcagcataggaacataatagaattgaatcaaacaacatagaatatcaaggattaagtttcccccaattttttatttctagggttcaaggcttcaagcaaactgaagtgaaaaggaatcaaatcgaatgaatgaaattataacataacaaacctgaactgaaaataaaaaaaacaacaaactgaagtgaggtgtatgagagttcagaggagcaccgtgctctgctgcctccacatcgtcgttcgtcgcatcgccgaaggtgaagagtggggagaccgtgagagcttgagaggtgagaagaatgcgttttgatatgtgaggatggggaggagagggggtaccgagagagagacagacaaaaacaagtgtgaatccaggggtacgatagtagttttcagcatacaaatttttttttttactaagggatgccacggcacctgggggtctcaatagagatccgtccctgattacagatgatgtacacaagagagcggtctacctatcttttcccatatttatatggatacgtttgaacaataccaactctccaagaactaaatcttttatcatatatatagatgagttttttttttttttttttttttatgaaagatatacagatgagttatgtacatcataattaatttctttttagatagtcggtgttgtcgaggagggggcatgaacaaatagagcacactgagttgtggacgattctgtttgaagaaccaacggacataagattaggtacaatatatatgtataattagtctttaatgcattgatatatacttcctcctttttaaaatgaatattgtttaagatttttacacataaattaagaaatataataatgatgtttaaagacataacaactttactaaattaatattatttattactattgatgcaatgttttaaaagtagtgtacactcactaaattaaaggatataattgaaagtaaaataataattctacattaaaaagtgtaggcgacattcattggaaacaatttttttgtctaaaatgatacacattttaaaacgaagaaaatatagatgataatttttttaatgatatataaatgagttttttgatttttgaaagggatatatagattatgtgcaacataactacatctataacaagtaaatgtggtgtaaagtcataatcatattaaaatacttaaacataatggagtattatataatgattgatttgatgtgatttttttgtcttcaagttgtttagtaattagaaaaccatctttaaggtgaataagcatgaaatctgatattcaaatctcgatccatgtatatataaatacgatatctgtcaattgagttatgcatatgatgactttggtgtgattttattaaaataaaattttgtaaagttttaatgtagtgaatatggatctcggttgaaacttgagagtaaaccaagtaaatatatttatgtttttggcctccacattgtttttttttttttttttgtgaattcttattagaagatcatatcatcgaagaattaggtgcttgattagaaaaggatcttccaatatttacctatctaattataacttaactaaaatattgtatttaaaaaaaaacatttacctatctaatattggatttttagcccttcaattttcaaagaaaatagtatttttctttttactatagagaaaagagtcttgataatctcaaagataaataagatcaaaattacaaaaataaataagatcaaaattattttagataaatattaaactcggactatggaatcaatatatcttcttaataagaatatccactttataaaaaaaaatatcatatttttcaagcaataaatgtgtaattatttattgtaaaccaaagtcaatttgagtactttttatttataatatcaacaatttgagtactatatccctaaaaaaaaacaatttgagtactataaataccgtgtgtggtccttctctatgatgtctcacatttgactttaatttatatactcaagagtcatgtcaaaagcattatatatcatgtggatttgtttttcaatgatgactaataattgtttcactattttcacattcaaaaaaagactaataattgtttgactttatactaggacatacctagtaatagtatctcaaggactccatctcatcagtactgtattttggtctacaaaagaactggttattcattttctgaaacagaacaacaaagaaattaagttacctttctttatatttttgcctcgttattcctagttgaatcccacacattatgttatcttccttcatgttttactaaattgtgttatttaaacacacttttagacaccgtacctaagaccgcatagctctatctatcacttgaattacgtaaatactcgagcacaaaggaaagttgtgtaatttcttgtgtccataattcctaatataccatacttctattatctaactagtcgaacaatcagcaacttcgtcaccttaacatgtcaatcctctcgagcatgtgtttgatatcaaaagaatgtagacaaacagaagaacctaaaatcttaaattttatcaaagcaagtttgtcattttagacacaagtttaaacttatgatagattgtttcttttttcgacataacctaagatagtttgttggtacaaggataacatggccttggtacgcatgaatctactgagaaagaaacacagcaacattttaagttaaaaatgctttaaaccctaatacataggttacaatatagttatacagcatctgagcaataacaatggcctaatcccataacactagtaataagaataagacagagatagatataaaaacaaggagagttttaccatcaccaaagtttgattagttcactttaaaggcctctctctacttcatgattaaaactattcacaagccaacttggtgtcaaagctgcttaaacatattgcaaaagcttggaatgcagataaaggatatcgataatccatggtaaacatatctttcccaactttgccgaattgcagaataatcttatcatgttctggtggtgctggttgagatggtgtcggcgccccagcaggtggttgggtggaagcaatcaactgaaagtttttaacagatgcaacagttactcgtccccggaaattaaggcaccagcactgtaattgttcatgccatcttggcggcttgtttttcagaaccaaaggtctcatcttgccgtcatcatcctcattacaggatcccccaatctcagaaaaccgtgcactgctgaactcgatggaatgatctagagacttcgaaaatgagatgctccggaatgagtcctccagggaacggtgaattagctctggctgtccgggaacggagccgcccgcatcaagtgccgaatttggtattgaatgcataatgcaatgcatcttccttgggcctcgagttccgagcacatttagttcatatgttacctgagctatgttgtaactcccagatgggacctttggcgatacctttttagaaaatctacggctcgtcttcccagtccccggagggcatatatgggcagaagtgcagggaggctgtgtatcatatatgatgaactttgttccaaggaagtttgatctggtgtatcaaaataataacaaataatcttgcaagtgagaagacagatataaaatagaacagaaaaaactcagcaaatggtcttggaagatatgaatagcaaacaaggaatatctgcatcacataagtggaaaaatattcatggaataagaaccctagactatttattacctccgataataacagttacaacacatttttgtataattatagtttcatgcatctaaacatatgacaataaaagaagtacttaatcttaaaccaactgaaattctagcaactttgcaagatcattgattcttctgttttacttctgggagttggaattcgttttgatattcggaactcggaatcataactcatagtagtttcaacagtatatttttatagacaccgaaaagaagtttttaacatagtagatgagagaaggaccaacatttgcaagtagtaaatttacctcagttttccaatgtaagtattacttgatctagagatgttgtcagcatccattgaaataacatactcagtgtaggttgttctcctggtcctcttagcagagaggaggaattttccattttcaactaacaaagctgcaaagtcaaagtaaataaaattgaaacaggaacaaaactaaaacgagttcatgatgctgtaaaaaacttccctagcatcaaaactttagaggtaatgttgctaaaataattaatataaaacgacaaaacagaccattaagcctttccccctgacataatggatatcaaacaaagaatatccaagactcctagaatcaatcacaaagggaaataaatattcatggaataacaacagttatagaaacatctcattttcatgcatcggcgcaagtcacactattaccagtgtcatccaaagtagatctcaaattaaacatcgatgcatacatcttcacgtgcagccacaaacaacatatgcacaaatattcatatagcagtaacttaaaaaacctaaactgtttgaattttgaaacattacataagaacaaatctacacaatcacaccagaagcatttgaacataaaaccatataaacccactaggtaactaggtgtaagcgaaagagtgtttaccagggctcagacaaaggaataggtggtatgttaagttagatttatctcttttgataaagcattgaatgattccatctcgtggccctggctgaaaagtgaaacgaacgagaaagtcagcatgttgctaccttatcaactatcattgttatttcaacataaatgtgattgattcttaataaaaaaaagtgagataatctgcaactaacctgcttcagggacacggggaacgttagtttgccgcagaactctgggctcctaacgatgtccttgcacatattcctccaagactggcaaacagaagcacatgcaactacatgctttcttgaaggccatgtattctcactctcctctagtcgccgaataacatcaaatagtaattccgggggtaagttcgcccagcagctattttgaattacaagaggctgatcatgcaaatcctgtacagaaccatgagactttcctctatgatgatggccagtaagtttgacatcaaagctacgcctagataagctcccaaaactatcacgaacgtcacgaactatgctacggaaagacattccgtagtaggaccccaagaataagtatctcttttgtgaacttctgatggactataaccaaccagtacaagcatatgctgccatcaaagaagagtattagttcaacagtcacattattatagttgaatctagctattactgttcattttcctaccaaaatactatctaaaaactaagaaccaaatcacaaagctt

SEQ ID NO: 35 - protein, 268 aa, Medicago truncatula
MAISHNTLAFAFGMLGNVISFMVFLAPMTTFYRIYKKKSTEGFQSLPYLVALFSSMLWLYYAFLKKDEFLLITINSFGCVVELIYIILYIIYATKDARKLTIKLLLAMNIGSFGLILLVTKYAVHGPIRVQVLGWICVSISVSVFAAPLTIVAQVVRTKSVEFMPFNLSFTLTLSAIMWFGYGLFLKDICIALPNVLGFALGLVQMILYCIYRNGDKKKANSKAALKSVVIESSLGGTGEVFQVEKNDGEEEEEKKKTIEETEYDSKV

SEQ ID NO: 36 - DNA, 807 bp, Medicago truncatula
atggcaatcagtcacaacactttggcatttgcctttggcatgctaggtaatgtcatttccttcatggtatttttggctccaatgacaacattttaccggatctacaagaaaaaatcaacagagggttttcagtcactaccttatctagtggcactattcagttccatgctgtggttgtattatgcattcctcaaaaaagatgaatttctccttattaccattaactcttttgggtgcgtcgtagagctcatttacatcatcttgtacataatctatgcgaccaaggatgcaaggaaattaactattaagctgcttttggcaatgaacattggatcatttggtttgatccttttggtgaccaagtacgcggtgcatggtccgattcgtgtccaagttcttggatggatttgtgtttctatatcagtcagtgtttttgcagcaccactaaccattgtggcacaagttgtacggacaaagagtgttgagtttatgcctttcaatttgtcattcacactcacattgagtgcaattatgtggtttggctatggtctcttcctcaaggacatatgcattgctcttccaaatgtgcttggttttgcactagggttagttcagatgatactgtattgcatatacagaaatggtgataagaagaaggcaaattcaaaggcagcactaaaaagtgttgttatagagagctcattgggaggaactggtgaagtgtttcaagtcgagaaaaatgatggagaagaagaggaagagaaaaagaagactattgaagaaactgagtatgactccaaagtctaa

SEQ ID NO: 37 - protein, 278 aa, Medicago truncatula
MVHRDNTAIFVVGILGNIASFFCFIAPVSIFYQVCKKKTTGGFQSAPYVAALFSAMLWIFYAYIKTGEMLIITINAFGCVIETIYLVIYTTYCSKKARIFTLKLIGLFNLGGICLVIILTHVLAKERTERIELLGWICVVLSTSVFAAPLSVMRVVIRTKSVEFMPFTLSLLLTTSAIIWLCYGILLKDIFVTLPNFVGITFGTIQMVLYAIYRKNKPVNDQKLPEHKDDMNENQLQVVVIPLQNVVDIETTMENKEEKKQEETKPSEGNQVQQQKEG

SEQ ID NO: 38 - DNA, 129204 bp, Medicago truncatula
tgataggaaacggcaggtctgtaccaatgcttggataacacaacttttaattatatacctcaaattacttttcttaatatgttttgttttaggttttgcaagttttttatggagaaattcagattggtactcatttgggaagttatttttgcaggatatttacttgaattgatttgagtctgttaaatttttatgatatggacttaagtttttgaataattaactcattctgtctttcaatattgataataccttaacatacttataatttcatctagattgctaactttgataaataaattatatagcaacatatgtttgttctcccatttcatgtgtcaaaataccatgatttagagttttatggtattcatctttgggaaaatttatttggtggtggaggcattctcaaaaaaaattatcggtgaaaatatgtgttttgattttcaaaatacttttatggggtttctattggtgaaaatgaaagtaataattttcattttgtcgctgaatatctatctcattgattggtttttcttatttgaaaataacaattaagagactatttttttagagagttctgatgttctttttcccaagtattgagtattcaaagactcttgtggttgatacgatcatatagacttgaaaactcaaagttgtcttccaaccaaacaaccctgaagagttgtgttcaatgtttattatgatagaagtgttcatatttggtgaatgatttacctcttaacatctaattagaatatagtttctctggcctcatcatttttcttaacttgattcgttcgttgatttattgtgacactgaaattttaagctatatgcagctgatttgatagtttatttatctgcattactatcatgtcatatggtgtgagctttcagatcattatgtattatgtttggaaatttgaataccagacatttcaggctttgatagcaatgttttagttgtgattggtgttatatgacagcaatgctgagccagggcgaaaaatttatcgcaacttcacatgtgacaatatataaacaatcataaatcaattttttttttaatttttttttcctcaaaaaaattgaaataaaagagttttgtcaacaaaagtacaatttaaaatagggttattaattgaaattgaccatgtaatatacgtgaagtctgaaaagtaaccttgtaaattaaatcacatgtattctaaccatgcaattcaagatttttattatttataacttgtagtatacgagaagtccaaaaaagcaaccgagagattgaattttttcatgatttcttagaggcgagttatggctttacacaaaaaaattataaattttcgacaaacgacaaactaattatgaatttttaaagtgtcaaaagctcaaaaaactaaacaatggcaatctcgacctataaatcgaattttgagctcattatttgcagagtcatctataaaaatacataaaaagaatctgtaaagtatcatagcatttcgaagtcgtttatttattttgatttttcaaccaaaacatgtaaaattgaaattttgttccgcgtaagtgtatactcacaagtcaaatttagttcccaaattttgtaggcatgattagaacatgataagaacctttacaatgaaattttgtagtttttaaatgagatacaaattaattataagttagtttaagaaattcataattatgagggaataaaaattcataattaatttatccctggtcgaagaaatttaattttttgtgtaagctatattttaacgtgctaaaaatgtatgaaaaaaatagtgaaaaaattcaacctgtagatcacatttttagactacacgtatattatagggtggtcaaaaataagaagaaattcaagttacaatgctagaatatatgttttatattttattgagtcatttttcagacataaagtatattacagggtcaatttgaacaattaacctgttaaaataagagagatgaatccggcactagtgtgctaaataaaattccaagacctatttgcgtgtaagaattttcagattgcccagatttttctttttgtaaatgtgttaatgactttttggttgggtctaatgtgtaaaaattatcgattgagtccgggcgaccgcccgaggtcgccgggcggtgaaaccgcccctatatgacagtctacaattcattcgaatatttagggtgcgtttgttttaatcaaaagaacatgtattataaaagaccaaatcaaggttagttatagattaatattggctttgactcagtattagcttattcatgccttaaaggtgtgttatcaatgggtctgatagacttttttctattttctgctagcttttttgtgatgaatcttttgaaaacagaagagaatggatggaatttggcaccaaagtaagacatagtgtgaaagaactaaaagacataaatgagaactatattatttgagagaaaagttgaaagagaatcataagaaaaagggtgaagcatatcaaagaattttaaaatcgaaaaatttgcatcatgaggaggtagatgttaaaaaccatctttatgcattcaatatatatttccgtgtaatagttttcattttcctctgtaatagtttatgttttttacatatacaaatagtgcatagttacgagtctacgttaattatacactggagactatataggtagagaattagaattaccaaagttacttaattacttcaaaaataagtgaagtgaactttaaacaaaatgagagatgtatctttcattcttttcctctcaatgaatacaattacaaactagatgagaatgaagcgtggatgggtacttaggctttaaggatataacttatgtggatgggtacttaggctctaaggatataacttgaatttgtttaggttctagtgatgagacatacttatctttagtgatcagacatacttatcttagtatttgtttaggttccttattgcagtggataggaatcatcttaaagataggatgtgggtacatcctcataattaatcgaactaattactctttttttagattttcttatatgcaacattggagttttgttagttattttgctgatgattgtttttgttaggttatttgatgtttatgttatcgacattaatatgctataatattttgatgtgtttcacatttttaaattttgtatcgtttgaacaaattttgacttcgtatttttaaaaaaaaaaattattttgtaactaaattctacatttaactaaagtacttgaaatttaatttgattggtaactaaggataaaattgtaagaaaaaaaaacaactatatggggtaatataatttatatagcttaaaaaaaaataaaaaataaaaacaagtttctaaaaaatttgattaccaaacgggttttctaattttctattttctaaagctgtttttgaaaattatgttaccaaatggattttctaatttcttcatttctaaaacagttttgaaaagtcacgttaccaatcaagttttatctttttctctttttgaaatcacttttctaaaattgatttttaaaacactttttaaaaactaaaaacaaaaagtgttctaaactgactcaaagactttttttatagtggctacactgtactagtttatcaaatgagtgaagcaaccgtgaaagcgtagtatagtttacgtgtgggtaatcccattttgaaccaatcaaaaattgagaatggtcctttaactttttttatttttggtggtggtcgggatttgaaccccgaaccttgcatatattatgcattgttcttatcaattaaactacactcacgaggacgatctatataactttaaacatttaatttaatgcaatttgttgggaataaaactcgttaaaaatctttctacgaatacgccttgtacttccataaataaatgagttaatggttctttaccccctgtaatataggtcatttttggtttttccctctgtaatttttttttttttgaataccccctaataggtcataaaaaaacgaaaaaattctgcaaaaaaaaaaataaagtcgtttttttatgacctattatgggggtattccaaaaataaaaaaaattacaggggggaaaacaaaaaatgacctatattacaggagggtaaaacaccattaaccctaaataaataaagggttactaccttactcccacctaaaactagcttataaaaaataaaataaaaaaactacacacatggcggccatgtcagcattgacttggtcaaaattggcctgggccaaaactgcaaaaggaaaaatacttagaggactgaattgtattttattttgttagggggtcaaaataatatcttggataatattatattttacttgatcagattgtattaaaacaactcatgactaatttattgcaaatattttatattgaaggctatatgtattaaataatcaagacaggcaaactcgcatgcacgcattcagacgcgtacacacccatagaaaatagagaaatagaacactagtgtgtcaaatattttttctacaatttttggtccttcaaatattttcaatccttatttttaaataatcaaagcacacgctcgcatgcacggaggcacgcacccatgcaaaatagggcatcgaattcataattccctcgtgtcgcttaaaatattaggggtgatggccaacttagaaaggtggaggaaaatctcttacgtttccactttcaacaactgctctaggtttggaaaattacttatacatggctcctccattgatgggaaacccctaaccaccacattattgttggacttttcgtcatcaacatagtgcacaatatccatataccataattggagatttttgagagatagtaatttaccaagtgataaaagccgcacacagtttttacaataagaaagcctgagaacaacttaacaactttgatttgtacccaacttaggaagtataatctgtcatagaaatgtattttcaagattttaagattggaatgaggttgaagcatttcatgtactttcccagcactagcaacaaatgtcttgattttaccattgttgttccatacagagcatatttcttgaagttcttttttagctaccttaattggcttcttaagcttcaaataaattgtcaacgttttttgacatgtaatgcttagtttctctcctagatttagacgatgtgattctgccaagttgtggccaatctctaatcggacaatgtttttatggattgcttcaatttttatatatatgtatgtatgtatgtttatttttgatatatacttttaaaaaagaagagcaatgctagcaacatacattcttcttgattgttttaaatttacatgggtctgaccaaatcatgtgggtcccatataaatttggtggattccatgtgaattttaaccaattaaagaaagtgtgttgctaccatttataaaaaaaaaaaatattttgggagtaacttttatctagagtagtgtattagaaaagggacatataagcatttgtgtatgtgagatgagcaattgtcttagaaaagggtgcaatttgtttgggcttaaataaaagacatgccggcccagctggaagtgtaaaatgacgatgatgatgattaccaagtcggcaaaagcgacgtcgtttttcgcaacatttcttggcgcgtgagtagtaggttgaagatgatgaagaggaagagagaagagaaagagtgtatggatatcgtgtggcaaactccagcaaatcctcctttaccgcaagattacatcgttcgaaacggtaacttcaattctctcacaagttccacacattccagtatcaactacgaaatcgaatttttcatcattaaattcttcttatattgtgcaggaattcgatttgttagaccatattacttcgaattcatcgctcatgttagttcactctgttcatttttccattttttattttaatcctcacttatactgttaaaaccctttgttaaactctagaaatcttcaatttgttcataattcgttgatgctaggttaaaaatcgatgggcggggaaaactattgtagatttattcgccgaggaatttaaaggtcgaccttatgaatattatgtaagtttcatttcttagtatatcatcattattatttttgagaaatgatattttcacatcaaaatttttatttcaaatacaacattcttacatcaaaattttaaacttaatggatatgatgttgcttgctaggtcgattaattgattgttttttatggatcttaggttagtgctgtgaaatgtggaaggattcaagttgacggtgaaatggtgccagtttcatatgtggttaaatcatcgcaaaagataagccattttttacacaggtttgaaaaaacacttgacgttttactttctaggttgtcatagaatttgtgactgattctgtttcggtttcaggcatgaaccacctgtgatggcttgcgatgttcctattcttcataaagaaccagatgtgctaactgtttgtaagcctgcgtctgtccctgtaagtaagtttattaagtggattagaagagtgccaatgcagctaaaacacccgtttggattggcttattttttagcttatgtaaataaataaccttttatgtattatgcataagcttgttaagacagtttatgaaaaaacatcttatgaagatacaattttcgctagcaagaacatatgaattaacataaaagtttatttatttgcataagctatttcttaactatttatatgatattctgataaaaatattttggtattaagttacattaaatcgaatagtagatataaataatagaagtattttctttttaaacagtaaagataacaaccaatgattacactataatttccacccacaattttgacaactatttcaaatcgttacatgttttgaatcttcaatttgaaatgcatttggtgaaataatctcctaactacgttttataatgttattgtttttgttataaatttttttcttattcttgttgaggttattttaggaaggggagatttctcataaacagttttagttgttatgtgaatgtctgattaggaggccatagatttgagctgttaaatcagtctcttgcaaatgcaaagttaagaatgttttcaataaagaatatattaaatccgacccttctctatacctcactggctcaccatgaggactttatagcatttgttgcatagtattgagaaggatatttgagcagcatcatttgtatgtattttaaaattaaaattttaatttaactgcgatgcttccgcattggccgtctgtaagacaaatatttggttcactgcctacgagcagccattcagcagcactcataacactttttttttgggtttgcagctacttcaaatgttggcaaaagactgaaattataattttttaaattttgtattagagtttgcatcaatcattttggctaatgaagctttaatgtcttttaaatctttaacactcattttttttcttcacgcggttaccactacaagaagaaacaaaattgaataccatccttacacttatttcttatgattggtcattgtgaaaggattattaaggattaaaaacgatgctctgcaatactttgtaggccttaagttttaatggattttctattagttgcctaagggtctggtgctttataatgatagtttgctttgcattttacacactgaactaaagctgtgaattttagctggtacataggttcatccatgtggccaatatcgcaagaacactgttgttggcatccttcaagcagaacatgggctggcgcctctgtttcgtatccaaaaattcattttcaatccattatataatcatcataaagaggtgtatcttataatgataaggttgtcaatttgaaattacattaaatatagcttctcccttacacattttgcatacttatatttgaatgtatctatccaatttttacattcattttcccttaatctctcagagtttaccattctgtacttgaattttcttttatatcccgaactttatccatttttgtacttgctatgttccttgacatgattgtctcagctgtccatcgactggatcgccttgtctccggactccttattatagccagaaatgctacaaaagcggacagttttagacaagaggtaagtttgggcttggacttgtctggtttttcactcttgtacttctattacgttatttaatcttaaataaagttgaaattctttaattttacgtgacatttagtgagcaatgtagttcattttgcttaagcatttgagctgtctggtttcttgactttataaatatgaatatttttaataagtaaattttctgactaaatataggagatttcatccattctttaattaaattatttcatcagaaaaatacaattatgacttatgaattatattctttggtgtgctctgaacagcgaacttgcgtatgataaacataactagcaagttatgcttgaaactggtatgtgttgtatgactattatattgcaagtttaaatgtatacctttgtcctggaatctagttttacaaaagttttttgtcgacatattcgtataaattccagacatgaggacaaaaggttcatggaatctagtttttcaaatggttctggtcgaggtctgatatttttgtatatagagcctcttaatttcaaatatctccatatatatcatatccaaaaatagtgattatcatgtaatctcaattgaccattgttggctgcaattaacaaatgtctgaattctaagctctatatacaaagctattgataaaatttgtattggaagaaaacgaaaacataaaagaaagttgttcagtttgctgtgtgatgtactcatgttatctatatcttgacaaagtcatagctttgacagaatttcttattcttgatttacaacaaatatatcaacatcaaaaactttttcctataccaccattataactgtagaatttgattgttacagattgaggctggcttagtcaagaaacaatatattgcaaaagtagttggggaatttcccgaggatgaggtattttatttggccttggatgagttactatactaatatcacgttgaagaaatgaaccctgcaagtatttataattaataacaatgtgacatcatttattttcgttctttgtttgttaacatagtatagcattgtcaggattatttattgattactttaataatcctttttctggagtatcattaaggattttattgacatttaaagaactcgatttgttaacagtgtcatttaggctatcattttgggtctaaaagagataactttggttggagatgcataaataactcaattatgaggttttggttgcattctttatggggcttaagagagattttgacagagggtgaataagatggatgtaagatatatgtgcactttgcagttttgtgtttgaaaaagcaataggatgggcatgtgcaggtgtttattgtcacattggccaaataatactgcactactgtccactgataacagtataattaattgaagttactaactttaatattgccataatgagaacggttgttgaaacttaaaaccttcaaaaagtacttggtttgagttttaagaagtgtacgcatattgttgggcatgtttctaaattatgaaaacagagagtaacaactaaacatacactggttaaccaattttttttttatctaagacgactagttatttgtttgtacttcaaagaactttcatttccgggttgtgttgaatttagcaatgaatgattaagttctgtactgctagtcaaaattgagatactattctcctcatgattatgtttttacctttcagataattgttgatgccaatatagattataatgctcgagaaggaagaagcacagcagaggtgaggcctttggttctatattgtttcatggtagaaaaatctagggcctgtttgatttaagaaaacattattttttttcactaaaatttttgaacgtcactttatttcaacctcatttttattttcacatatttgtacatgaaatggtgaacacaagattctgttgttttgttttcacctttttcattacaaattcctaaaaatataaacaaatgaaaacagtgtaacattattcttattattagtgaatcggaaagaactgcttttataatatagcttattttctggagctagttttctagcttcagagaaaaacattcaaacatatatattttagaaaatcaattctacaacctctagaatcaattttgatcactccaaagttgaatccaaacatacacttaacctttatctaaatgatcataaactatatttagtagtgatataacatccttccttcaaagttattggctccttttaagctcaccgagtcactcaacacttgcaaatgttaagtgcgaccaggttagagtgggcagttgaatattaagtttgattctaactcaagttcagctgaaataaattgttagataccttttaagattttgatcaccagagtttcacactatcatacctagtagaaatataatttaaaaatcattcacgtgttttaatattacaccttaacccttttggatagttggttcatgatattatatttatatgaaaatctttgtcaccaatatatgttgcattcttttagtaaaatcaaatttaattacaagatagatggattgtgcattatgcagctatcaagccaaaaggactattgcgagagggacacactagaaatataatataaaaatttaaaacctcttgggtgtcctcactatcaattgagtctttaaggatagttcagaaaacaacatgggtgttggctattgtattggttattatgatgatctggtaaaaactaatcattgttggaagaaaaatgaaattgatacattctgttgataattaaaattcaaagtggcggcaagggaggagattatcttatatgataaatctaattgaatatatgtttgataatgaaggtcagagactctacaaaggggaaggttgcctccacaaaatttacccggattagtagcaatggtactcatagtattgttttatgcgaaccagtcactggccgcactcatcaggtaagaaaattgttggcggattttattgatttttcttcttctccagacttaagcagcttattcgagtatgctttctgttttagctctctattttaatatttttcctcagtgtcgatctttttagcatgttgatgtaattcctttcatgtatcttttatatcttcattctaaacattactttccaaaaaaaaccattgctggtaccttcaaggggttttgatgctgagctgttgccattgcatgaatatatttagcatgtgaacttcctagtgatgcgtcacaacagtcactgatagcacattcctgattaggtcacatgcttcaagccagtcatgctatcccagcgcatatacacatatatgcttgccattgtttcattaataaaccttatagagagtatatgtaattaagaaagaatggaaactgccgaagcagttgaaaatgtgaagtcaacaatcgactaaatgcatcctgcacttcatcttatttaaacctattactaatgcaaatatcggagctaataagtacctaccttttatgtagatacgcgttcatttacagtcttctggacacccaatagccaatgacatgctgtacatctcagagcagactgttgatagatctattaatgggtcaactgctgatagatcagcttgcatatctgatgcttctttgacatcaaatttcggtgaaaaagtgcccaaagattatcaagaaaattccaacgaggattttcgcattgatcctatgtgtacgaactgtccaaatttggcaccgaaggggtatgcaattctttaacttcataaaaagcaaaaaatatttgctacttgctttgtattgtactaacttgaaaagaaagttaatacagattatttcgggttcaggcctatgtctagctatctatagtttaatgatgttggttgtgagggtagattttttgttgtggtcaagccctcattgttatgtcactagtcaaagtcataatagttagagaagtgtaaattaacctctgatacaatgcttacattacatgtgttgacccaacccatgtacacccctaattttggcaatgaaaaactctgtacaaatatggagatgtagctcattccactgctgatccaaataaatgtttaaagtccctatggtgcaacaatattgaccattgcaagacattaagttaaaccacacacgttaatgttgttccttttctctgtttttcagttttgttttctatttatattttatggaatgtaggcttacatgtgacttgttggtttattttatgttaaacttccagtaacttaatcttgtaatccagtggattctattctgcttcatgaataccaattttattttttaaacctcagacagatctatcactaaatttattttgccaaattttaaattgtagatatgatactgatgaagaaggtttgtggttacattgtatgcggtactctggacctggatggacatatgaatgcccatatcctgattgggcgaaactttagctagatacagctgaaatatattttttcattgggctctgcaaacaaatatacgacaactctttatccgacaatcaaacctaatacacttgggttgatcccaggttatttatgcgtcattgacgttttttatctgagctgtgcaggttataaaatcttgctattattaaactcatcagagaggaaatagaatagtcattattctttattccctgctttagtgagggaaaggatctaaagatgggatgttttgtatttaaagatgaccatatacttcattggtgcaagtttactcaatttcggtcaaacaatgtcttgactaaacttgaatgcgttgcatttgtcaaggtaatgggtgcaaaacagaaaccatgttttataaggaatatgttgtaacaggtggctgcacttacggaccaatttcaaaacaagatgcagtgtttgtgattgtcacgtttaattcttttgtataattgatcaaatctttttttttgacagttaggtgtttgaatctttgaatctacttttggagaaattttagttcaaagtctgaaaaggaaacttgaatttgttaaagacaattaaaattgatagttccgtcctagtgctttcccaaaaaaatagcatttcccaactcccaggcttgaaccagacgtccaaagtttggtattcatattgacttgagtcaccactactcgacaaattgacagctttcttgcacttctagactattgtgtaatgtttgaagtaatttataaaggaacgctagtttcagcttttattatgtgcggtcaataaattcttaactcgaaacgtagtttctataaatcattataatttcctttttccccttattatttgaacaggatttgttttgttgaaggatataaataaatttgccaagttaagggcgtaattgtaaagccatatataatatattcctagtccttgctgcaaaatgtatcatacgtaaactttgtaaaaacatacttgtaattaatagtgaaatacttctttacagtttatgctcaatcaaataaaatctagtcgtggaatagtcatcaacggtcgatattagtgcgttgtgtcaatatctaaaatttgcttgatacgataggtgcaatgagcatgccgaggttttttttattttttttagcaaaaaaaaaaaaaaaaatttcaagattacaaattactacctccgtccttaattataagaccattttgagaattttttttatccctttttataagacccctttgctatttccaactacattaattatttctttacatacatgcccctattaattatacatctttttcttcaatcaacaataaataatatgttgaaaacataaaccatctctctcttaaaggataaaattgtaaaaacaatactaattacaaacatatttaatacaaatatcttctatcttaatttccgttaatttttcaaaagggccctataattagtgtcattggcttggtcaagtaatacttgtttatctggaacataatctccagattgaagttatattgaagttttatattaccaaaatatttgggtggactattggatgtatacctatgtttggacacctcattcgcacgaactaattttgaagagtgagatataaattcagtatgacacagtggttatgttgattggaacataaaaagatgagtacagattaattttttaccagtaactttttatatcacaactatcatagctgcgtaaggatgaaatatttctaaaaaatatgtaacccaagtagaaggaagtgtgtaaaacaggtggaaaaggttggagcaagaatggtaagatacgtttcgaaaaaaaagttaagaatggtaagatatgattgaatcatgtatgagctaagcaagggtcgttaaaaagtttatgtatgtatgtatgacacatggcgtaaccttagtcactgaaaaatataataaaataaatcagaaccatatatactagtagaaacttaagcatactatcaaagacagcattatgagacaatcattggtatagagtcgaggtttaatgtaccatctcatatattgacatatgaataaaaacacacaaaacatttgaagaagaagattgacttaaattgatagatatgacattaagatatacggtgtttcaggagatttaaaatcgagtaaacaagtggttcattacatcatccttatctttgcattgcatgctggcaaattaaattgtacgattgagatttgagcacttaaccacacctaaccgaacaacgcacgtacatgcatggcatggtgctttgttccaaaacaatcataagcaactttttggaataacattggttcactcatttgcgtaaagccttaaaatgcttatcttgagaagcatgatcatgatgagtcttatttatgtggtccattcttttgtttcacgttaagttagtgcttattattcatgtatttttctccgcctaacataattaatttttggattcatcctaactcattaattaaaactccatattggtatagacatttggagcaaactcattcatatatatatttttggtatatcttgattggaacgcgacatattccttcatataaatcaaattcacaaaccccacgaagatttgatggagaggaagataggatagtaaaaaaaaaaaaacaattgccttgttcttctgttcacatgaaacatcatgtggtggtccaaaataacttgtatgacgaaatatcatattccttttcctctaggaaaaataaacatatgaaaagagttcaaagtagttcactttattttggttacaattgcatggcatgtcaatcaattacatgattggctgtcaattcagtattgtgtacgaatttgtacctgattaaccaaagacagctgccaaaaatactcacgagtcattgtcgtattgaagaaaaaagaattcaaatttgatgcggcaattccgatattcacgcaatcaagatatatgttggtagtcgttggaacaaaatcggatgatctatattttaatgtggattttgattattttttaaaattgaaatacataatttgaaatttaaattgtctgatctcgacctaacaaccgtctcgactatgtgaaagtataaattaccgactagaggaaattaaagttacaaccatcaaagcacacatcgtttaacacttctacgtaatgtaccaatgtagaaaatttaacatagtattagagccgaatgacttgtatcaatgatacatgtaaaaaaataaaaaataaaaaaaaatgtgtttctaagattaaagaagaggaagcatgaggcaaatatggaatatgctaatagagtcatatagttgagacactaatgagattaattcaattgaacttgacgtgcagcataataaatataaatctcatatcaaataaaaaatagaaagatgataagttcaatgatttcgattatttttggaggatagacctctaaaaaatcaattaatttgtttaagcattgattttgtaaaatttacaatcatataatgcagctgaaattctgtatttaggcaaacttctcatgaggtcaactctcatttagttttcttttctacaattattgtctttctgcagcaatcaaatgacgtataaataaaagctaacagacaaaattgtgccaaattagtgggaaaacagagtaactaaaaaatgacctataaatacaatattctatcgctatacgcctattatacctataaataaccaaggctaaaatatcatgtgacagtgacaatttaacaacaaaattcctacaccacccacccatactgtacttagtgcagaagaaagcaatattacaaaacagaaataatgaaaccaattctgaaacaaaaaatatgaggctgctgcatcattgatcttacgtttcatacacttgtcctctattttgactttgagttgaaatattgagcactttttttgttgatacataaatgaaaaaaaatattgatacctctattattaagagtcaatcataactttgcccttttaatcctgaggtttggtgatttcaaatcattggaatattatatatttactgttcactttgttcctaattatgaaattctttatgaattatgagagaaaaattgctactaaatgcaaaaccctttgcaaactactagatatatttgttatttttttttaaaatatatcttttataaatatattacaaatttattttggaatttgaaaatttcaatatcaaatacatttatacgcaaagagtaatttacataataaccaacacaaattacttgtgataaatgttaaaatgtcttaaaattaaggctaaaatatgattttagtccctgcaaatatgcctcgttttggttttagtccctgtaaaaaaaaatttgtttttgatccctgcaaaattttttgtttttgaaaatagtccctgaccccacttttgtgatgatttgcatacgtgacacattataattgaaccaattttgtagtttttggtccctgcaaaatattttgtttttaaaaaaggtctctgcaaaattttgtttttgaaaatagtccctccagggactattttcaaaaacaaaaaattttgcagggaccaaaaacaatttttttttttacagggactaaaaccatattttaacctaaaattaaagaacgatgagcgacacttttgcttttgatgaataataggaaaatctgaccgagttggtacaaagagagtctagctgtttttcaatttcattatttttatgaaaaatgttacatagacaccctttttctcgtacactcttatacaccctataagagaagaggagatgaaaaagaaaatgtatttgtgtgaagtccacataactacgtatcagatttttgtgtgagtgttaatgagtgtattgtcacttaaggttgtcaatttaacataactctatttttatgctgtcgtcacgaagatatacaatttcactttttgggatggcctttatatctccattgtccatgacatcataaaatagaaaaagaagcccccacctctatctatgtaaactattttacactagatgaagagagatattttgttgagaattattcatggaaagagtcctcattctacaagttagttttatatatgatgaattaaatccgatctaaattataagattttgcatatccaattttaaagagattgagaattgatgaattggaacttagtgtactttgattcttccatgataaaaaataattttgaattaattaattttatttaaaagtaagtttaatgtaaaataatttatattcgcatacatttctgtaaaagtgtgaacaataacttcgatttaaaaatcacttttatactcaaaagttgcaaattataggtttaaattaccatcaattctataggcaaaattatttttactcgagaacaattaaacatgccaaaatcaattttacacctcagaaatcaattcataaaactttcttgttacggctagtgttcaattactcattcatgaaaatacattaattaaacaaaagtatccttaacacctgcttttgtaggaggctccacagcactataaccatcataaagtaattaaactttaggttaacttttctctaacctcatttctatttttattttccctttttgagctcacactgtgtatagcagcacatctcattcttctatttattcttttgtttctcattttccgttatttggatcctcatcaccgatcactgcgacagccggagcaccacttttgactacttgattcgggtcgggttggagagcaccattgggcacatcttcacaaatgttaagaacatggtcatttggtttctgtaacttcgttgactctagtggaatggcatctttataaattaaataaatcaccatctgaactataccgaaaacaaaccctagcgtatttggtatctgcatcatccaagtgcaaatattatatcactttttttcttaaccaagtttctctttttttataaaacaaaatgtaatcaaatgatattgttttacacgtgcatatgtataatataataattaatacctaatacaaatatacgtgcttagaatacaacgcccatgttgctctttgatatattttacatgagaattcatccaatatgaacatttcaaaaagaatgtagagatgcactcttatcatttttaatagaataacttatttttacaataataaaatgggggaaatatatataatatttattaaaatatacaaaaaaatgataagaatgcattttatattcttttttaaaggtctatatttgaggcacccgagaactcaacaatgttcgtggagctagcacaaacaataaaacatctttctttcattattgttattttcaatttttcggtataaaaatataaataccaaaattatcgtaagttaaaagcaaagcatttcctagattgtaattagacaacaattatttactatgtaacaatattgaatgaacttacagcgatataaaagtcgtcgataagaagaccatagaagaaccacacaatagcatttaaggtcaaaaagaaagacaaatttagcggcatgaatgctacacttttcgtctttattacctgtttctacaagtagagatgaaacatggaattaaactttagcataaaatctagaaggcataattataaaataaaatgatgatgacataatctacttaagaatatataaatctttacatatataattgttttgaaaattaagaaataactattattttcagaagtaaaagaaatgtatacttcttcagttgagaataagacttattaattagattcttaaaaaaagacttattaattaattagtcccttaaaaaaagacgtattaattaacaagtgtaaagaaaggactgaagaaattacaattccgtccactctctatgcctatggtttctagtacaagtaaagaatttttttaacagttttagtgcacaagttaatgagccaaatatagaaacatagttttaaaaattgtgcattcattattttgaaagtttaaaaactttttgtttttaatacaaaaattatgttttaattcctttttgttagcatgattcttattttttggtcaggttgttagcatgactgactctattaactaccgtaaaacaaatggccaaaacataaaagttaagaaatgatatcaaattctcaccaaaataaagagaggagaagcaaatacacatatgttaaaaaccatacatatccatccaataatagaaagacgtttggatccctttgttaggtatgtggttaaaataaccatcgtaccatatccacacacagttaagaaaagaagcttgatggtcgaaagctgcatacacattaaacaaaattaacaataattaaaaaaaaaataattagatatttagaaaaagaaaggtttaaatttagatatacccttgctttatttgaggcataaagtaggaagattataatgtaaattgcctctattccaaatccatatatgttaattgtgaggagaaggagtgtagctttgtttttgacatgtgcataatagatccaaagcattgcactcaacaatgcagtaacataaggaactgattgaaacccttcagtagatttcttcttgtagattcggtaaaatgttggtctgcattcaaatatttattatttatttaatactccaaacaagataatttatggaagataattacatacatatacgcaaatcgaatgaatcacttacaatggagcgaggaaggtcatacaagagatgacattgcctatagttaaaaataacacatccattagcaacttttattgatttataccttaattttacatggtttatgtataagtacattttacgtatacatgatcaatacacattgatcaattaaatcatgtttgcgggcctacccacacattacatctgtaaaaacttggatagtgttatattacaccctcaataatttttttatcggatacctatattacttaactaatttttatatgaatttgtaattatttgatatgtagttaagattagagctgtaaaaaatgggccaggctcatgggccagcccattggtccatatttttgggccgggtcgggcctaaaaaactaacaaaaaatgtactcggactttttcggcctaagcccatatgggccatacaaaagttgggccgggccgggttgggccaccgggctttgggccggcccattagcccatatttcattttatttttgttaaaaaacaacatttttttaaaaaaaaattatcaactaatttaaaatttattaacataaaaatatttaaataaataaacttaataaatatggatgaatttaacttacagtgtataaattattaatttgatttaattgaaagaataatctagagtttaattattattcaatgttaatgtaaaaattatttatatttttatgtccatccaatcatattttagcaaaaaaataatggtgagtaactaatacataagaaaatacataaaaaaaagtgaataaattttaaaaataaaacataaacgagccaggccgggctggcccatggcccacccaggccaggccaggctctagaattcacggtccaatcataaacgggccggatcgggctgacccatttctatagtcgggtctctcgggcccgagccgggctgggccggcccatttaacagctctagttaagatacgttaatattattgttatttattaaaaaatattatgtaagacgttattctcaatacacctcgtatattaaattatttcaaatttactttaaaaaatatatgaatgatgtatatgatataaattaactaacaatctattgataactgttgctcttgttgggtaatgaagaccgaagagtataataaattagacaaaacatctcttgagtggaaaaactctcatggaaaaactcttcggtgattgcatccaaacctttaattacactctctcttatttcttaacattaaaaaacacaatgtttcacttttataatagatgatcaggatcacacttgagaagcaaaaacaggagacaatctcttcctctattttaattgttaattccttttattttttggaaatgtgtcaaataataataatgagatgagctctcaattaatgaataaaaaagtaagtgaaatatagatatacgaaaacgaaagagtaaagaaaatgataaattaaagccataatataagaatttaatcaatatgcggcgtaaatgtgcaattattttacacaattatttaatgttatgttttttaaacaaaatatttaatattgtgttggtacgtcaattaacgaatatcaaacaaataagttgtaataacacaacaatacataattaaatgcatgtggaaaataattatatactctgtcggtctataattaaaacctaattttttttttttttaacaattaaaacctaaatataatgagctgcataatatacctataacgccgaaaacaaaagcccaatactcgctgtaaaaaagggccatttcgtcaagttgctagcaagaatggaaattaagaagaatatgattcttgcttcaaacaaattaaggcagtcgtctcaacactattttgttaggtcccattatatctccacacaccagctgtctgtcaatagcaaaataattaagagatagtaccctaaaataaaataaaaataaaaaagtaccctaaaaaaattatagatattttcttgaggcaatagaatagtagatatagatatgacgcattaggaatataatgaaaattaaatgcatacactgtgtctccttaaaaaaaatgcatacctgtgtttgaacgatgaaattaatattagaaaaaaaaaaaaaaaagatttttaagcaatttaaacttttcagttgaacttctttcatttcaaattttttgggtcaaatttaaaaatatgaaaatagagcaacattttgggaccaactttcaattttaagtaaatttttaggcattaattacaaaatattgaggataaaattgaaattaacgttgtatagagtagtcaagaaatttcaaatttttaattttaagtggtatttgaaattttctgaactaagtttgcaaaatatttcataaaatacctccaatcttagaattcttcaaatctatcattcaatcaattgatttattttgaagaatttgaaatactctataaaattacattatatcaaaaaactcactcgggtacatcatatcatttatttagatattcaaaaaaaaaaaaaaaaaacccatgtcttttatttttttatttttaacttttgtgaacaacctatcaaaactgaacccacttgagtttacttggtggtgttgacttgagaccttagagtgtgctcctcctcctcaaggtcgcaagttcgattctcactgttgttaatttgagtgggctagtttaacttgaaagaaaaacaaaactgaaaaaaagatgaaaattaaaatgtactatgcttatgctgaataaccatgaaaatgcctaacaccaaaagagaaacataccagactcgagaagagaaaacacatcaggactcatccatcatcctagccataggaaaaacaaaaagctaattataattctatgtgaagaacacctttccacattggctatttatggtgtgtcacaaaatatacgattttaagcattcaactcacaatatcagtcctaaaacctactacaaataacttattcattgcattctctccttgctgctaagaaaagccaggtggggtggatttggctcctctacttcaccaaactcagctttagacttttattagatattacagtcggcatcaccacctttgctagattcaagtccacttgctggccatccccttcaatattttcattggcaccatttctttacattttttttttagggatagaagcaaccattctttacataactagtagtattaattatatacatataatttgtgaattaatgtgtatatttatttatttatttaattgatatgtataaattatattgtgaatcaattattatagttgggtcaatagaaatgtttggtttaaattaaaatcatcataaaagttggatttacaatttgttgtgattgtttgactatataaaagctttacattttattcagtaaatagataaaatgagatagacaatgaaaattcacggttatacttagatgtctaaccttgaagagtcttagagccgaggaatgatcactttccaccaatgaatattctaattttaattttttttttttaatattattgctacatccttttaatattgatcattgcatttttatgaccatttatctatcacaaaattggaaagattgcgataagcttagctgttgaaaggtttttacatttgagtgaaataactttatggctaaaatatggttttggtccctgcaaatatgcttcgttttgattttagtccctgtaattttagtttttagtttttggtccctgcaaaatattttgattttggaaatagtccctggccccacttttgtgatgatttgtatatgtggcgcatgatgactgaacccattttgtagaaaaaagtccatacaaattattttgtttttggaagtagtccctacaaaggtgacaaatcatcacaaaattgaggccaaggactattttcaaaaataaaatattttgcagggaccaaaaactacaaaaaaaattacagatactaaaatcaaaacgaatcatatttacaaggaccaaaatcatattttagcctaacttaattatcaattaccagaagtctaagacatttaatcaatgaccattttaacaatatatttattttagtatggtttgttatacaactcaaatgtataatgtgagattcgttgtagctcctattgcataggctgagtccgataaatactgctcatatttttttttaagcaaatggattttagatggtaaacctttctgctccagttccttacttcgtccaattttccaattctttgttcaaatgtaggatatgtggcaagtaaaataccaacggttgagattaacaaagtttcaccgttcctctccctttcacgtcttctgcttcattgagtcgtcatcttccttttgtcgcgttacctggaagccgtcgtgaaggccaaccgctccgacgtgattctccaccactgcgccatctaccttctgccgtgttaccaggacgccgccgtgaaggcccgtcgctccgtctaggttcgccgccactgtgtatttgttcatgaattgattacactgcaaactaaactctgcataaaatctgcaacattgagcatcactattgcataattaaatctgcattatttcttgaattggtgaattcctagtagaccttgaattgattagtcaccatataacttcacagccctaaactaggaaaggggcagatgcagtggaacttgaaaagctgattccacaatggaattaaaacagtgattcaacggcggcgtaaatatgcagcggaaaaacggcggagttatggtggtgatacgacagcgagagttgagatgaccaagcaggagacgtgaaagggagaaaaagtatggaggatacggttgacaagaagaggaacagtgaaacgttattaatctcaaccgttggtattttacttaccacgtgtcctacatctgaacaaagaactgaaaactggaggaagtaagcaactggagcaaatctgtattcttgcagcatcgtaaatatattgtccctgtaagcttatacatacagacgccaaactagatagcaaaaaaaaaaaaaaaagttttgtgaacatttgtgatggtgagttggtaacggaaaatgagtcgtccgccaaaacaaacaacgatccaaacgctctttcgagccaaccagacccaatatgcaacaaaacaaatatgagaaaacttgatccaaacaaaactgaaacagcatggcgatgcctagatcttcgatcacaaagataacctatcatcaaacaaagttcatatcgagggatgaacaaacgatagagttcatcacaatccatcaacgatacaagaagcaacctcgatggatatcaacaacaacgatccttcgaaacagaggcagaagatttggaaacaaatcaccacgcaaaaaagtttctcattcgtgaatgttttctcaaatttaggaaaattgatggtttgatcattcatgaaggtagctacattgataatcattagattaagattaattaatagattttttttttaaatagttaaataatcaagtgtgaaatttgaaatttattatctcaatccaatgactaccgatgtgaattgagggcatatattattataagaaaaatgttaccttatgcccttaaggcacatgttaagattctaaatataaaaattatatacatgggaaattgtgccaatttatttctcatataattgaaattgtgccaatatttaatgtttttcaataaatatttttctttttataaaaaccttaacatgtggcataagggcacaagttaacacgatgcttattataattaggttgaagtaaacaaaagagaaattacataaaaagtgataaagtaaaaacaagttaaaatccacaagtagagagaggaagatacagacgtcaatatctacaccgtctcttctcctttatatgcgtcttaaaatattacacgtaattcgaatttcacacaaacaaattaaagagagatggagattgtgcccgccaactatttctcttccattaaacttcacaaccactatctttctcctctgttttgttgatattaatgttgtcattttcattcttaacctttgttttgtcctgagttacttggtcttgtttcttctctttctcatcatgttcttcatcttgtttctcttcctttttctccacaatcaccatatcaacaacactcacttctagtttcttctcatcatttgttgttttacttggaactactacgttttcaatttctttgtcgacaatgtctcctttatgttctggtagcttctcatcaattacgggtttgctgtttctgtacattgcatagagtgtgatctgaactattccaaatgttaaccccacaacgttcgggagctgtccataaaaaaaaaaaaacataagttttgttatgtattattccataaagacaaaatagcaattaattaatacaaatgcaaacataaaacaaatgtttgaaattctgttacgtcacgcgtcattagagaaagacattttcatagtagatacactcactatactaaaaaagtttaaacaacatagtagatgaatgatgagaacttacagtaacatagatatctcggagagaaagaccatacaacagccacataaccgcgcttatgaggaggagaactgaaagtggaaaaggaaggaactctacacttttggtgcgaataacaactctctacaagatgattaaaaccatgcatggatgagaaattaattaagcttaaaaataataatttaaaaagctaattcaagcatgtcggtaagaatgttaattaagatgcactcacgataatgcttaaaggggcagcaaaaacactagtagcaaaaactacacaaatccatccaagaagcttgatacgtccttcttcttgttttgctaggaagtgagttaacaagacaatcgtgccaaatcccacaaagttcatcaacacaatcatcctcaatgttgacatctacataagaacaattttttttaaaaattaatatgtttatcatggatatataattcatgacatctagagtattcgaaaattttaaaaagagatgttattgtgacaactaataacatcctagcaactttagctatgcaagtaaaatttaatatgcatatcactcttatacacgtaccctaactttcttggggcagtaagtaacaaaaactgcgaggtaaattgtctctatcacacaaccgaatgcattgatggtgataagaagagtttcacccttcttggtataggcataaaacatccaaagcattgcactaaatagtgcagccacatatggaattgattggaaaccttctgttgatttcttcttacaaattcgataaaatgttggtctgcaaaaatataatatagttttattttcaaagttcatcatcatcatatattaaaatttacaattaagtgaagtggattgaaaatattattgtttctacttacagtggtgctagaaagcacacaaaggatgaaatgttgcctagaactccaaaggcaaaagatagatgactgtggtgggacgacatggtaattgttatgatcttatgaaaactctttctttctctctctctctgaatagtcccttgtgagaagggagagaaggaaggtttaaattgaagaccaaactctagcttaaattttgtgtcacaaacactgatatgaatatgagtattggtgagtcttcttatatataaggtagatggttcatgcatggggtactgtggggggatgtttagctgtgctattttgcgtggacattatggaactatgaattaatcattgctttccaccacattattgctttgaaagccacacgaaacaaaaacaaaagccaaaatataattatctgtttgctttttggggataaaatgtcttaattttatacaaattaatgaattttgctttaagtataacattaaaaatgttgttaaaataagtattagcattcattaattttttaaatagtattgattattgttattattattattattattattattattattattaatatcacataaagtgaagtggtagacaagttaagtaaggcaaaaactttttcttatactaacaattcatcatttttctcacgccaaacgcaccatgattgccaactcaatactccctttcaatttaaatataaacaacaacaaaaacatttcaagttaattaaaaaaaaattgatttgaaatagttagttttttcctccttaagtacaacttaggtggcaaaaagttgcaatcacattttctatgtttggcttggaggttcaatcagatttagttctccttcctcgtgagcttaactcagttggtataaacaatttataatatatacaaggtttgaggttcgaacttcggccaccacaaaaaaaaaaaaatagttctccaaaatcagcttcattataatttaagttctttttcttgatataaaacatgtatctgagttcggtactaggaattcaccaagatcagagaaagactcaaggtctcatgtgcgctaacaaagatgtatacaaacaaactcacttgggttgttctggtggtattggtttgggacttgtgagtatgctcctcctcgaggtctcaggttcgattatcttcagtgtcaattcaagtggactaatttagcttcttaaaaaaaagatgtatacacacaatcacatacaacgagacttaaataatttctcactaactgaacaaaactaatttgaccattaatatttaagtttatatcaataaaaattaaaaaggagtaatttttaaaagacaaagaagtaaatatattttagatgctataaaagtatgagttttctttcctaaaaaaataaaataaaagtatgagttttcgaatgtaatccctacaaaagaatattcatttttagtttatactttatatagttttacaaaaaataataataaaataagagtgcttttagtccttgcatttagtttacataaaattaaaataaggactattttttttttaggactaatctcaaaaaaacaaaaaaaatatattttgtgggatgtatatgagttgattgttgttattgtataataggatcatttgagggcttgcaaatggatgtgaagatcggttatgatgccttcttctcttattgagatgtcttcttctattgtgaatcatctacaccttctttatggtgttgctttaataatttggagttccatcacaatataagtaatgtctaacaatttttttttatttaagaattaaattcgaattctttagaacgattcgtcatttgatgtcctacaacttattgattcataaaaaattattcttgaatataatttattaaattttaaatataatcgtcatcgtaagtttaacctaattgatgagaactttaaggctgaagttcgaatctcaacaacccacttatttatcttgccgtgtgaattttaagccactatgctacttgactataataaaaaatataaaaaaatgttgaatataatctatcaaaatatattcaaaatggaatggagttagtttttttgtgtcctttcaaataagaaagttgtagttaatgcttggctggcccccaagttacttaatcacgcgtacaaaccctccaggccaccacttcctcacgtgacacttctccattatttgcattcattcccacaccctgatcatgatattcagtctaacaatttcgacattttaccagttaagctaagagttgcagatcaatcaacatttattctaaactatgagaattaaggtcatttgagtggtattgaattttgatgatattattgtacgtattttaatgagagataatgataaaataatgattaaataaagaattttgctaacgagtgttttaagagcattctttaaggatttcaattagaaaattattcattaaaaagccaaagacttcaatttttagtgcattgaatgcgcaaatttcaaagttccaaatgattatatgatatttttttatcacatctggacggattgctgctcgaaacaaacaccttttttatcacaccagatcatccctaatatgaaatctttttatatgatagaataaattacactttccttctctcaaagatgtttaaactacactctcctccctcttatgttaaaatatacacttccctcccctcttattcaaagcatattagaaaaaatttcgctcccctcccctaagagaagcttgaattatactcccctcccctcttatgttaaaatccacactttactccctcaatatttttttttttatttctaataatctaacaaaaaaattaataatctaacacacattcagaaaaaaaaaatagtattgcggggatattttaatataataaaaaatggcttaattacctttttggtcctctaactatttagttggtatcagattgatcctctaactaaaaattgatttatttcggtcctctaagtttctcaccgttactacatttagtcatttttgttagttttattcaaataaatgttagggtttgtttgaataaaatctcctaacatttatttgaataaaactaacagaaaggactaaatatagtaacagtgagaaacttagaggaccgaaataaatcaaattttagttagaggactaatccgataccaattaaatagttagaggatcaaaaaggtaatttagccataaaaaattgaatacatatcttttgctattttttattcacaatttcatactagttttaaaccctattataaaatatgaaacaacccaaaataaagttaaaatatatgaaaaattactaaagacaataaagcattgctatttaaaagttaattttatactctaaattataaaatcaatagaaaaatatttaaatttaattatgattgacatttaaattataaagatttgaattaatttttcttaattggtggttaaaaattaatatataataaaaatatttatttattttaaaatagattaaagtgtagtgcatatttaattattaagggaagaagttgtaattcaagcatcatataagagaagtgagcatatattataacataagagatgaggatagtgtaattcaattatagtgtaatttacactattttttatatagcttgtttacactattttttatatagcttgtctttaatttgtttagcagtgctttatttgatttgagtaccaagtcgccaaactcacctgactgaaccaaccatccatccactactattaaaagcaacctattaaataataaaatccctaaaaatccaatgatttatagatgtaaacaaacggacacgtgtaaaatgggtttacagtcatgcactattgctttacattttagaggagggtaacattgtttatgtttatttgtttgttgaatggcgactgattcatatttaaaatatgttttatattgatcaaactgctattgtgctctattttctcatatcttttgactatcacgcttgaacaaagctctcttcactgggaaaccaagtgacaagtgtaaatgttcaatctgttgagaatgaaacgtatctaattttacgatatttaattattatccgtgaaattcacttgcttttcagctgctttgttcgaccgtacaatagaacagtacaactttgaatgtgattcatttttaatacaagtttaattaacggtgagacttcggttacttcccgaagaattgtagaacaatactagctatatatatatatatatatataagtaaaaattatgaattcagaaagatattttaattttctttaaaatatatgaaatttaaatctcttaccacataaactaatttattattgatatttatattcgctaatgttcaagatatttcactcatctttatctatataaagtaaagtttaaaagatccaaaatctccttcgtaggtatggttgggctccaaagtggtgggtgcatgcagggttttagatatagggcatataacaatttaagcttatgctatctagtttaattaatgtcaatagttagactttactttagcttctcttccatgattagcacgtacgtttcatactagtttttccacgttgataatttattcaaattcaaatagcaacccacttattaaaaaaatagtaaaccacttaatttaattcatactttttataaaagaaaccccttatttacatattaaatttataaattataaaataaatattttttttgtaaaaaaaaaaatacacataattatataaaaatgatctattatagcattaattaagaaagcaaatataaagaaattgtgtgagaaaacgtttttttttttaaagatgtgttagaaaacgttgttatcaacttttagagataaaaaattgttatttaaaatacaaaacatccattatttacttttttaaccattatcttagcgcattgttctttaataattcaaacaaacgtgtacttttcttttcgttcatggtaacatttacggtagtgtgggatttgttgtcgcgtttagaaactggatgcaattattatggattaacggtcgctagtacaggtcaggtggattcaacaatgtaattttgaaccaaactttacattaatatacattctttttttgagggatctacattagtatacataaagttattagaaagtgcgttttaaaaagtttaaaaaaattaaaataatgatgttacagatgagatagacttacacagatacaacgaagtctccatttaatctcttgcttgtctttttgtgttaaaaaaatgcatgtgcgctccacgggatttgtttttcggtttcaatggagacacaaaaaagaagaacaaataggaaccgtcgaagtatatataattaatgatcatgttcctttgcaggaaaagaaactcataatgatcatgtttcatgtgtgcaatattgcttaagcatagttctaacacattaattgtgggagactagtttattcaactatattcaattattgtttgtaaaaatattgattaatatttcttgattttgaagattaaatgataataattaactgttagtgatggaaagcaaaatcaaggagagaaattaatgacggaaaaaataaaattcctaacaatttctttagttacaaaatttaatgacggaatttaaaagaaatttcatatttttcctcactaaattttgtttttttagtagtgtatatagatccaatcccattggcaatttagcaatgtttaaattaagataatcaaaattatgatttttttgaatttgtaattgaaaggttttttcattttctgacgattagtctggatactagaattcacaattaaggtaaataattggagttatcggagtgcatttatatgctcacgcaaacttcattattctcgttcactttttttatcaaacggctgcaacaactagagtaatattgaatcttttttttgttttttttacgtaaaattgagtcaaatgcgcgtcgccaaccaaatcatgcactacgtaaagacgtatgatttggcaagaagcaaaactgcaaaagtaaagagtttcgtaaggttctaattattctgagtggtacattacctccctgttcagaattaattatacatgattgaaaatatgtaattcatacgtgtatatactcttgtggctcaaacttcacaggtggttctatcatattttcatcaatcaccatatatatatatatatatatatgattgattgatatttttacatgttattattatttatatatgacataataattatcttgtatatttacttagattttatttttgtgaagctcatagagctaagaatggtgccctacaaatgcatggggctccttgttgtgtgactgtgactcatctcatgtaggtctaagtacgtggacggatacctgaaatagtctagaatttcctaaaagagtcaccgttggatgacttcatgattgaaatgaaaattgaccaattccgtactactagctaatcctcgaaatctcgaatttgacggaatagaaaatttggctaaattattggaatgtctgtccaagtacaccaagacagtttggccaactccagatagatcttcttacgtgccctaatgcatgattgtttaatttacattgtcaaccatatgtgtgtggataatagctatgaattgtgatgatatttcactttgatttagtttacgcaaaataatttttcgacatcaaaactcatctgcattagagagagaaagaaataatgagagtggtgtgatagatgttacgttattggttggtgatgtgataggatgagaaaaatagatagaaaataagatgttgaatgtatgtaaaaaaaaaagaagcgtattcaaatatataattgcccttaatatatacacattgttaatgttatgattttttgtactaacaaggaattatctagactttcctcataagggattacaaattcacacatgtatattcctgatatattgacggtttaaattttttacactgacattagagctgaaggctggcactaaggaaaggcaacaacctaaacattgcttcaaagttcaaaccaccatactcactcaactaaaaagattcttagttgggcctcacttagatttcacctctcatttggaataacatttttttgttcccgactcaattatagatcacgggaatgctgtatttttcgtcatttttcgaatccagatttggctggagtggtgcaattgtcaaagaactcaagcaatttcacacccgagaaaccgattacggggtttaaatccgctcaaaatattgggtttgcggtgtgaatgaatatatagtttgcatgggaaacattatagtactgatcacgttttgcgaatctatttgatgaaatggtccctccctgtgacaaaaaagctagctgggcaaaattgtcctcaacttaatgaaactcttcttaatgaaaaaccatacacatgcttttcgtacaattaattgccccagctccttgttcgtttatgaagcttcattaaaatagctcggaatttagtttgaatataagtaaaaaaataataatcacaaatatacaatccaacaacgaagctagccaaaattttgtgatgggacaaatatatgggaaaaaaaaaaaaaaaaaacttttacgatgattattttgacaatttttgtagttgaacaagtcttatgtatatttactatggacactgaaagtgataaaacgagaaaaataaatttatttataaaatgtgttgtttttcatatttctactagtaaattcctcaaaaaatatttctactaataacttttacaaataaatttatttaatttgtgatagctaaattatattatgagagtagctatacacaaaaatacaagaacttataaaaaaaattaagaaaaaaaaaggaggtgacattaacaccgccaagtgtccctaccatcatttttttattagggttaaatatgtttttagtctctctaaatacacaaatttacgtttttagtttctaaaataaattattcaaaatttgattactctaagtttttagttatcaatttagtcatttattgtttacaaaagttcacattgcgtgttctaagtgacctttttatgacatgtcaatcttaaactatcatcaacttaataatttaactatttaatctttaaaacttgcgacatgaacttttgaaatggactaaaaataatagtcggtatatatatatagagggacaaaaaatatatgtaactcttttattataataacaaaatataattctactttccaaaagaaagaaaaatttaattcataaacataaagagtttttacaatgtaaatcaatcatagacattaaatcattataaacttttgaatttaatcataataacttttaaaaaatcacattcattttttttttgtcacataaaaatcacacatacatgatacatgttattttgatatattgatcaatgtaaattttttaacattaaaagtgtatcaaaattaaactcacaaaagaggttattgaaactcaaaatataaattaaatgaaaaatattttaggaagaatatgatttatacatatagtagaacatattttgttttgcctctttgttgaggacttgatgtctttttgtattcgttcgattgatctctttcggttggagtactccttgtgctccccttgatctttatatttttttgtctccataaatgtatcaacttttcattttattctctttaaaaaatttctttaatttttagttctctaaaagtttttcatcttcacttttagtctcatctttaaagtaaactcatatttaaaatttgtatttttttaataaatttttgcagcaaaatttataatattataagaatttctccaaaaacaaaatagaatttttatattttttgcggttaaaaattcatatttaattttttgtttcgttaaaaaattctatgtttttgagtgatttatacaatattctacacaatttcattaaaaaaatacaaaaattgacttgaacatagagactaaaagtagtgattgaaaatattataggaactaaaaattgaagaaatttttcagagagactaaaacgaaaagttagaatatttatagggatcaaaaacatatttaacaatattagaagaacaacttcttcgtaataggctaccaacaaaagacaatcatgtgcggcgatgagtcctacacatggatgacacaacgtgggtgggaggctacagttctacagagattgcagatcatcttcttttcggttgcgatatctttggtagcgtgtggttcgcggttatggggtggctcggtgtatctttcgtcgctcctgttggctgccgtgaccattatcttcagttcagacacttggccggattaccgcattgttctcattcgttccttcggattatctggctagcttatatttgggtcatctggcaggagaggaacaatcaaatttttcatcagaaggtttctgaaattcacattgtagctgacatggttaaactcttatctttctagtggatgaaggccaatttgcacacttttgttttcagctatcatgactggtggttgcaccctatgtcgtgtatgtgtgtggtgttgtaatcttcatgttattttctttttttgaatcaggtgatccgacaatatatctattttaggtgattctcttttgcacgtcttgtgcgagatgcataaatcacttatgtttaatctagttccattttagaagttggagaaataatatatcaagtgagttcaatcacaattcaactttaaattatctactccaattgaaatacatctagaatacgcgcgaatatataattcatcgtaaacttttcttcgtatcactttcaagatcatgcgatacctttgcattgtaaatacgttgtttgaagttcaccatgtctccagaaccacaatcattttgccgcttcgcaaatcctctaggacaatcaacatcttgaactaattattgtaattataatgtttatatataataaattgacgtccttgtaaattagccaagtgtttttaacttttaactaattaaactactcctacggaatggaccctatatcattagtgatatacacatatacatatactactccaccatggtattattcattaattggttggtagtgatatacattcattaattagatggagaatacatacgattttgatgagtactatatatggaattaataggagttagcttagtgaacaaataataaacatgaggtatagtttggtaagagagtgatggtagcattaaattaatttagaaaatgtgaggctaactatgagttagattactttggcatgaggcaaaggcaatttactatcaccgctagtttaatacaatttgaagcacattcattaaagacgatgcaatttgtacatctttttcgttctcagccactacataacaagaacgcaagcataaattgtggactttggttcttgcatttagcttatatgcttaaaattcatattgagagttgaatagcagtcacattctgggggaattaataaatatgccatgttcgcatacacatgaaatggatcgatcttatcttgtccatgtcgtcgtccacgaggccaaaattattgaagacattataagatacgataacatcaaatactacaacgaagtccacataaattctttgcattcgtggacagccttgaaaattcagagaaaaatatttaatggcgcttttatatatggatttagacgatttcaatcataaaattgttcattaaagacaaatgtttcatagaaaaatataagacaattgttagatagtgttttttttttttctttcacgattttttttctgaactgttgttttcaattttcatcggtcttcaataggatttagggggtgaccacgatatgacaatacttccattatatcaccattttctaattaaaaacaaaaacaggaaccgttccttcaaaaaaaacaggagctgttttgttatttttattttaaaggcgccttgttggtggagaagtgtgcgtgtttatatataaattatcattgatttcaactttccaacaatgcgagacttttaagatatacatgaacaatgatcttatcggatttggccataccttgatgacgacaggccattggaggagagacggtgatcttcatggtggttggcctagcccctagaggaatggagggggttttgtaccagcatgtgttccgatgcccaagtaacaaagggacaggctagggttagatgagagatactttgtgatgtcttggttgtggatttttctctactaagttctaaaacttctctttaacaccttgaaaataccaaattacccctaacgacagttaactagttcactttcaattaccgttaataactttcgttgcattctggtttattccataacaacaataccacctccaacagtgctcctgaacacaaatcaacctctttccatttgcttaacaagtcatttacttatgtatggtggttattttttttatttttttaaataatgtatatgtgacatttaattgttcctaaaaatacagtgttttaccaagatatggtggggtttagtatggaaaggagagttgtttcccaccatggaaaacttttttcaaccatcagattaaagaggtgtatcaattttatcatggactgccattaccatattttttttcctttctgtttctctcacaacctctttttttgctcagatctgaaatttttttctttcctaaatctggaattttttttaagatctataaccggctcataagtgtaaattcaattagatgaactaagaatgtttggaagcaatttttccggtgtctggtagttggtttaattttttcggtgctcaaacatactcttccaaccaatgattatacatgctagattgacaataacaaaggtcacattaatagcaccgattcttggtatgtaaggaaacattacgaacttcttttaactgaaaaatgaagttttatactttcatattttaaaatttggatatgtaaagtggactttttacatatctagctttcatttcacaaatagaagatgagaatattttcaaattggtttgattatgattttgattttgatttgagttattgaattgaagatgagaatagtagaaattatgagaaatgaatgtttttagagagaaagttgttaaacatgattttactcataaaaagaaagaagaaagaagccactggtgagataaacgaaattagtgcatgaagaaagaagccactgggctgttttcattcaaggttaaaaggttgaagaaagtggaaacaaaaaatctagtgatgagagatcatgataagatcaatgttccttgttgatctaatggttaaaaaaaactttcccatgatgggaaacaactctcctttcccatactaaaccccaccccaagatatgccacaactaagacgtgaaagttttgttcacactacttgatatatgcatataaaacaatagaataccacatatgataatttataattttatttcatcttcgtttaaatcaggcaattataatacataaacacaattaaggaagtcttacatgacattcttcctaaggaagttgtatctttatgatgtaaaaatttatttaattcatggatgtatcagaaaatgttggctttgaagtgtctaatactcagtgtaatgatttgctagtctcttcgaaaattcaaaagaatggagataacatattttgtattctacctagtgagctacataagttatcaaatcaaatcccttcatataaaataagtagtgacaacaaggaaagtgttccaatatattcttttgaactttatcatactatcctaacaattaacatatatcaattgacaaagaagaataatcaatcttaacacaacatcttggaacacactccctttcgttgccacttcaatgccaacatttttagaaacttcaatgaatcaaacaaaaatctacataataatgatacaacatcatctaaataaaacataaatcaacataatagatcatggatcatgcaacctaacatctttatctaattccttcatgcaagctctgatttattcgtaggttctgaactgattcaaaagatatgaccagtgaagctctaactcgatcggtccttcaatgttttgtttaccaaatatctaaaacatgttggttcatttagcaagcaacggttaacttctgttggaggcgaacaacagttgaagtcgttgggggcattttagcatttggggagagggggtgtcaaagagaaattgtagaagtgggatgagcaatattggttagttgctttatataagccaagtgaatagtagttggtccttgttaggccatttaccttgttggacttcaaatgacttagggtgttaggacccattattgaatgagtgttgctctttcaacatctaaaattgctcccacgcacccaaatattaccttaatacccccaaccacaatagaatcttaaatagcaaatatcttattgtatgatagacacatgtcttcacatatgagctagtaacttagggtgacccgatcccttgttggattgagctttggcccagtttggaacatgcataaaattttataggcacgatgtacttgagttattatgttgttattttatgattcttattttttattgggccttattttggtgtcatattcacattgtagtatttcaatcctagtatagcacaatgtagtcggacctttttcaaagaaaaaaaaaggaatttcttttccaaccccttatgttcacgattatatctttcttcaccctccaagcttctcgcgcaccctgtgattttcgttttttacctccattcgaattatataattcgagtaatgcatatattatatatatgcttatgctgataacttttcatatgatgacaaggacttacccataggggtgggaataggtcagaccaaactttgatagcctgagtctggcctacaaaaaaattgcaagtctgaacctagacaatggcctttcgtagacctttttgctggcttggtctggcctaaaatcctttttacatgcctatttcataataaaatcattaaatagactattttatctacttgtaaataggctcaacatgcctaaaagtctattttagtatagagaaattatatttgtacaaccattttgctgcaactttttaacaactatctctctcatactcacatgatgttattatcctctctcttcctttttctctctacattgtttttgaccaatcaaaagagaggaaaacaaagttgtcaccaaagctgtcattaaatggatgtacaaatatcattgctctttagtataatgctttcctatcacattaaggccttaaaggcctttttcactgcaaaaccataaagcctatttaaataatacattatttgagttgtttctttatttttatgtttaatataaattaaaaataagttttgatcatatgcataaacaggtcggcatatcaggcttcctaagcttttttttatagtctaatcctaacctatttacttcaataggctctttcaaaagtctaagcataatctttttaataaataggtcaagttgtaggcccttgtagaccggtctgaccctctgttttcggattatagaatatgaattgagttttccctatgtttttaggtttaaaataagtttttcacttattacactgaataaattgatgatcatgtcggatatgagtttcctcattgcaaagatacaaacgtgtggtggttccactcctcatcaacaaagggcaatcataaaccttttttccctctacgtggtgcaccttcgcatatagattgaatgatgtgtctaggatatgtgaatgacaaccatttgatgaagatatatttgaatgattgttgtcaaattcctcccacttccctgctatggaaacaacatttttgagaagatgtaaagtcatgggatgaatatatcaagaagatgattgcctataatgaactatgttgggcggcatgttatgaggtaataggagatgataatttgtaccttgttgaaaaccttgaccctgaagagaatgttgatgctggcaagaatgttgaagatggagtcaagattgaataggatgaaagcctggaacttgatgattgtagtatagatcttatggcggattagttgaaatgtatatctcaacaactgcataataatttttttatataatgatttgttaatataattataagctcattgtcttttatataatgaaaatttgttgaatccacaaagacatgaaatcatttcaaatagtttgctaaactctggcacatttcagattatgaaatccgaataattgtttgtattacataattcaaacaaagggtattttcagataatattaaggcgtgcgaaaaacttttaagatagaaaaaagtaatagtctaaggagataccaattttgtgtgcgatttttcttccaattttactttcaatgtgtgttacacacacttgtgtatttttatcttggtagtagtttgggtttttgggctccatgtgaagaatactatatataaagggaatatgggagtttgggatgattttttcattcttcaattttctcccttttaaacaattttttttaattgatgtatattttaagcatattatttttcttataaaaacttaaaattatagtttgaaaattatagcgtctaatctcaatcaaacaattatcaatgtgattgattgcatgaatgattctcgaataaactttttcgatctaagttattagatccttaaaaaaatcgaagtctttagagtacatcatcaatataaagtatattaaatggtgtagccaagatcctaagttagggacttcagactttttaacttcactagagataccaaagttttttgtagttattttttcatttaatgttatcattgttttcaatcaaataactaattaaaatatatatcacatgaaagttagaattttaaagatgaatgccataaataataagaaattagcgatcatagttttattttagtcaaagtgatcatagttacagtgaagaagaaaaataaaataaaataaaaaggaagatggagaatgacatactccatcagttctaaattatagacaaaaatgaaacaatcaattcacacttattaaaaaaaaaactaaaacataataattcggggtacaacttttcgtgttcttctctgaataagttttacagaaagaagtataaacaatttttattttttttaaagaaagcatgaacaatttttactgattattggttatggatcaaagggggtgtaaattgaatacaatttgcatttaattttatcataataagtaaaaaaccaattgagaaagctgtttttttttaaacaacatgattaaataaggtaaaaatttgtctttttttgcttataattttaagacaatgaaaataattatttttataatttagaatggaaggaggataaagttatgaaagtatatgaaatctatcaaaaagaaatgaaactatattaaatattaattaagtaatacatgcacgcacgtgcacgtgcacgcgctcgcgcgcgcccacacacatgatttaatggtaaaggcttctcatatgacttgtaaaaattgtgttcattccaaaatgtctcatattaacttcagcacaaatttaattattaataagaaaataatgtaaattaaaaggaatatatatatccttaaaagatatatatatatatagggatttgctagaacacacccactagtttttatgtgggagtgttttagcaaagctacaccttaaggtgcaatagaaaagtggttatatacatataaaagagaaatgatatttaaacaactatttttaaacaacttttgtgacaactttctctctcatactcacattatatttttattctctctctttctttttctctctccattcttattgtccaataagaaaagaggaaaaaaggttgtcaatagagttgtttgattttggttgtccaaatatcactcctcaaataaaaagtggttatatgcatataaagaaaagtcattaactgagtcagatgtcatttatatgagccgaggaaaacttaagctttagatacaaaatgtttggagcaggtgcaaattaaaaatttcaagtggttcaaataaaaataaaattgagcagtaaaaattagtatgacatcaacatcagtttacactatctactctctcagctttgtaaaccctttcataaacaatctcataaatttgatgttgttgtctcaacataaccaaaatttgtgggtatgatttcttgcaatgttttgaacaaaggatagttggaggtaaaattttaaaccaactccatttctaagttctaaccaaagggctttctaattggctaacttcaagaaacattctaatatacaattaccatggatgagcatatacttacccttgcttcaagaaacattctaatatacaattatcatctgtaagtgacataaatgctagataaaatgtctctatcacacaaccgaatgtgttgatggtgatgaggagagtttcaccagtcttctcataggcatagcattgcactaaggagggctgcaatgtacggaatagattggaaattttcagttgatttcctcttataatcatcatatattaaaaacatacaataaagtgaagtggattgaaaatatattgtttctacttacagatgatgtaatgttgcctagaactccaaatgcaaatgatagatgactgtggtggtggtggtgggacgacatggttattggttagtttatattacagggagatacagagataaagagagagaaggaaggtttttattacaatatattgaataaactgagttattgatgatataggttaaacatggatatgacatgactttttaatttagaatcaaaggtttgttattcaacagtataatatgacttatatatcggtgtcaattaatattcattctatattgttattcatctagattatatttgcgaataaaataaaattctagaaattaattttcaaaatcaaaataattatataatattatattttcgaattttttttataattttaatttaattcagattttttttataatttttttttaaaatttcgatatatattaattttttcatttgtttaaattttccagatttttattaaattttctagattttttcatttttattaatttttcaattatcttttcagagttttttcatttttattaatttttccataatttttttaaaaaaaatcacaaatgccacatgttccccataaaaaaataaaaagaattatacagtcaatatgccaagtcatccgaaaaaaggtgacgcaacatgtcacattagcgaaaatgcacagtcagttggcctagggggtattctaaaacaaattttttttgcaaggaccggataaaataaaaaaatttacaaggggcaaaaccaaaagtgacctatattacagggggtaagggcatattaacccttaattttttatccaaaattataggccaacattattattccattctttatttcaaaaataaaataaaattactattataaggatgacaatgggactcaagcctaatgaacacccgtaaaaaatactcataaagagcggataaatactcgtaatgttgggtttgcacttgactttgggtaattacccgtaaatttgaacatgtgtggacacgagtacaagcactctagtgtttggcccgttccacgctcacacaatatatatactgtaactattattttttgtaatactctcttcgtctcaaattataatttgtttggagaaaaaattgtctcaaattataagccgttttatataatactctttttttaaaaaacttctacggtacatttgcaaattaaggtgtactgatagtttataaaatcatactaaattttttaacatttaattgtaaaaaataatcaaaattttctattatgagtaataaaaatttagaaaaatttccttcaaaaaaaaatcaagaaaaattaaattttatttcgtcgacgtttttggcaaataagatttagttattataattctaggtattagaaaataattttttccttcaaaaaataacttatttaaggatttggtgtaccaaatacactcaaaaaaaattacgtaccatagaatttacccttttaaatttcaattctttaaattttctctttcgtataccctacatgaatgattaatttgtaaagttacttagcatttccgtttctttttctcttagtaattacatttttttaattaaacaatttataatttgagagagaagtaattactttgactaagtttatgtgcaattatttattatagttgactggcggctcaacatacaacaaaacaacaacgaggctgattgccacatcatctcatgaaaaaggaatctatgaaatcacacttcacatattacaaaagtcaaacataaactcctccttttattttatcacaattattttttctttatttacttaatttaaataaaaataaataaaagatcaaactaagactagaagcccttgttcaaaccagaagatcaaacacaaatgcatcctccggcgccggcgaactcagtgcccggaaatactattgatccttcgctcatcagaatttatcgcgcttggaaaggaaataacgtaagttaagccttaattatataaggattaattaagcttttctattgtttaattatcattactaatactactttttttttttcaggtgttttttcttggagggaggtttatatttggacctgatgtgaaatctatatttacaacgctctttcttgtgattgctcctgttgctgttttctgtgcttttgtagctagaaaattctttgatgatttccccaatcactctggatattcaattttgattcttgttattcttctcacaatctttgtaagtcatttttattcatatagttgctcaaaagtcaaactttattatcaagtcagttgcttctgattgaaagtgtgtcccacgtgtccaaaatatgtgattacattcaattatatcatttttctcaaattattattgttgtcgatgtgtctgtgtcatatatgtgtccgtgcttcataacttgaatccattagggtagtgctttaagtaggcagatttttcctatgacctgcctgttagttattcttaactcatcatgggacattttatcttttccaacttcaaaaaatttatacaatcggttagctgagaaggacttgaggaaatcatcatagtttcaaatttgattttttttcctatttagaatagaagaagttcaacatttggacaaatttatggattctgatactttgtatggctagatattttttttttggaccaagtatacttagctagatataaataagatttctggatattacatgtggatgttgctaagattcttaaatggtgtcataaactctatgaactacttagatgtgtgataagactagacgggataagattagaaatgacacattagagagagagagttggggtagcacctattcagtagaaaagatggtggaaaataggcttaggtggtttgggcacgtagagagaacacttgtagattttgtagtaagaagagtagatcagatggaggatagttagattacaagagatagaggaagatctatgaaaactataagagaaactattaggaaagatttagagattaatgagttggatccaaatatggtttatgatagaacattatagcataatttgatccatgtcgccaaccccacttagtgggataaggcttggttgttgttgtaaactctatgaactacctttgttaagaattggagctagggatgatcactttaaaatgaaggaaaatgtgtcaggttttggccatagtaattgggaaataaaaaaactagcgcgtctctttctaaataagtcatccaagaagttatctcgactctagaatttgattttcataatgaaatattttcttggtgaatggagttataatcacttgtttgcagctcttccatgttcatagctattactaacttttagagggtaattatgtttactcttcgtactaaaacaaaaaatgatgcttaaaaatacatgaatctgaaagttgagtgtagattacttttactttttcagtgcttttcagtacatatgaaattttgttacaacacaatgtttaatgtttgccactttaatcctaaacacgttacacgtattgccaggttctgattgctcttatactgacctcaggaagagatcctggcatagtgcctcgcaattcttatcctccactcccagataattatgatggaagtgacagtaacaacagtgaacaaaatccaccaccacatttaccacgatccaaggaagtaattgtcaatggaatagctgtgagagtaaaatattgtgatacttgcatgctgtatagacctccccgctgctctcattgctcagtatgtgataactgcgtggagcgatttgatcatcactgcccatgggttggtcagtgtattggactggtaatgctagttaattatatacaatatcagtactatgtgttccaatttaaaggattgtattcaaaaagataattgggtctctttataacgtctcattataattttaatcaagaataatattttttgtgctgtcattttaatttgtcatctgtgttatgttttagatttcaactattgataaaatcttcttgcgcaattatgaaatcctgaacaaacaattttagtggagcattgactaagttgtcaaaggggacctcttcccggaccctgcgtatgcaagagctttagtgcaccaggctgcccttattgactaagctgtcaatttactgttatcaaatggttatatttacctcctaattagaaatggaataatataatcatattctagttgttttgtgtatatataaaaaatagtaatggttgtttctttgcatgtatattggcattttctgctatattccaaacatcacactcattggtacaagcacaagaacaaacacaattaataataatacataattatatttgcagaagatatgatcatgaagttgctaagttagaattttctgcttctttttgcctctttgctttacatgtacacggcgacagcgcaattaccggttctactacatgtttgttttctcagcaaccatgctttgcctttatgttcatgccttttgctgggtttacatcgtgaggatcaagaactcagaggagatatcgatctggaaagcaatgatcaaaacccctgcttccattgcactaataatatattcattcattgctgtctggtttgttggaggactcacttgtttccatacatatctaatcagcacaaaccaggtttgaacactatttaactcataatcccttgaccttaaatgcgactacttaatatgtcatttgtaaaagactcattcctttctagttcatttttcttacatatgttaatgattgttccttttgttctatgtgcagtctacttatgaaaattttagataccggtatgaccggcaagtcaacccttataacaaaggggtaattgagaacttcaaagaagtattctgctcttccattcccatatccaaaaacagtttcaggtccaaggttccaagagaaccaacagaatcatctagacgaagaggtgttgatacccttatgatgcccgtttacaatgaggctgatgaggtggaaaaagattataaagacgaggaatatggcaagagtagtgatttaagtgatacatctgtggatttaggcagtatgcttcacacagaaaggggacagagacaagttgcttcctttctaaggcagtccttgtgggaacaaagcagcagaaaatgggaaacagcttctgatgttcttgatgaggtacacgaagatggggaatcaaagcggatcaccagtgatagtagtaatgaacctgatggcaactcaacaaaaacacctctataatttcagaaaaattcaaagatgtaaattaaaactacaaagaaaaataggtgggggatagggaagtacggcttgtgtttctttggttgaaaaatgtcattggatcttgctcattgattactgagttttattttttttgagttattctgtggtgatatagttttttaaaggtggcactcgtgtaaagaagtagaagatggtgaatagaaattgtggaaagtgatccttccattatgttcatttacttttttcccttcatttcttttgtttttgtccttatactattgctccgagaatttaattgccggcaccatttgatttgacttcagcattgtttttatgtttgcggtgtattttattttgttttatttattatagagagggaaaaaaacaggaggataaactgtattacatcgttatcattttctccgatgaatgaataggatagtcagagagtaaggtaaatactccatagccgtaacatttgtacttgtttttcctatgtaacgacggtttgaattttggttgggggtgctttgaactttgatacttcattgataataacttgccaaaggggattgtgccgtgatattggtgcatgtaaactaaaatatgaccaactaactaactagtgatccaattgtcaaattaaagcatttacaagtctttaacgagaaaaatgcctacttgaactaaatttgatttgtaattacaattttatccattattaaatttctattttaccacattatcatctttgtatggtaagctttcctatactgtcgtcaaattttgttggcaagttgttcatactgtatagcatatctgtttcaacaacaaagattttggaatgaccgaagaatcgactgttcatgttttgtatcgcgtttttatggtactgtacttttattgaaattccgaagtaaaatttttgtcaaaattttgttgaaccgttgtaattttgctaaattcattaccattaacacaaacataaactatacaatgatagctgatttgtgtaatgtgcgagtttccttcttcgaccttgttatgtgaatgtgtgggttgtgacaaatttggcaacgttacttagttttttttgtgttgccgtttggatggttgtttgtgtggctagtttggaatcaacaatcttcactattagtagttagtttttttttggcttagcctccaattcttagttgaaggaagtcgtgataatctagagtttgagtgagaggtaaatacaatttaattgaagattgatttgaattatgcattaatattagttcaaaccaaagcaacaaaactataaacattatagtggtgaatcaaattacatattttatcttataatttaagaagaagaaaaaatcattgagaatgatggagaatggcaagacatgcaatatatcgtttgaggtttggagaagtctaagaaactgttagatgaatggatgagaaaaactttaattcttattttttttaatggacaaatattagttgttatgttagtattatgtacacgattacttcctttctcatttcttctacccttacgggtttgagtcctaaagtctttctttttcttgtaagtgaagtactaccctctcaccataaatttattatagaaaaaaaataataatagtaaatatagcgtttttttccctttcttttccgtatacaatactactatctgtttactacgacaaggataaaaaaaaaagttataatgatatatcttctgccgtgctaaaatcatgtaatgggaacacttattctgaacatgccgtgtttgtctcctaacttaacgtttgacctcaagattgtacataataaataaatgtcaccgtttcgataatgcctagattcatgtccaaatttctctaggcataccaaaatcctccaattggctaaggcaataaaatagcaagcaaatcttaaaagcaaaaagaaatgccattatccagatactggaaatggattatggacttcatgcaatccctctttcaaacttttcctccttcttcccctccttctccaccagtggaactgtgcaatgacattctctttgaaatctttctacgcctccctcccgaagtgctccctcgtctcagcatccttaacaaacaatctaatgaaatgattaaaagccccgtttcaaacaacctattgggcacaaaaactaagactccctcgcctttgtgctatggtgtattaccaacgtaagttgacaaaccgaataggttttaccttgatcaacaaggaacatgatcatagattggacaagaatgagttccataagtatacacaggttcccaagattaatttccattctagttacaacactaggctccaccaaaggaccaaatccatgcttaaatactacgagatggggcaaaatggcaatggctaatgccacactcgacaggccaacatcacggcagcttgaaacatgtatggaatctctaccttttggttgcaaaaaaaaatatatacaggcaaaacttggataaaataggagtgaaaatgttgttcagaatggagcaagaatgatgagaaagaaaggtagaaaattcattgcttaggtcgataattgtaatctataattcataagtttaattcaaaagtatatacaatttagcattttgattaaactgccaaacactagatgattgattgacaaatcaataaaatccaccaagcattatctaatggaataaaagaaaatagcaatcagaacctttggccccaactcaagctgaagatggaaacactaatttgcatggaaataaaaattacacgaacaagaaatatcaatttcaagtgcaaaatgaaagtagttggaatttgaaagcaagaacatggcaagacccttggtaagctgacaatatatcagtgctattataacaactttcccacattttaaaactgatacatgaacccttcagtcaaacaagctctaagttattaaccacatgcactgagcttttcatcatcaatgctgaaaagtaaattaaatattcggacaccacgtctcgacaaaatataaaaagaatccaaaatttgctaaatattaacgacaaatttaagactgtttgttaattaagaaagcacatcaaggccgttgatcttcattgcatactctgaaaccgtttcatgataagcatgctcatctccacgtaacgctgtgcacagtgtgttaggcaattagtctcaccggaactgaacttattccccggcgtgcctgtgatgcatttgtcccagcattgactagtcatctttgccaccatttcattaatcatggctctttgttgttcttcctgcatttggagggcaaaattagggttgttatattacattattggggaacaacaggaaaagttaatttagattgaaatattgaaagaaaaaaatgcctaaaacagaaggcagagctcaagactaaatataagtggtctatatcagaataccattttgagcccctaagccataataatgataactggcagtggtcaaacaatgaaacttaaacatcatgtttgttgtgaatccccgatcgcctagatcgaaccacaccaatacaaagaatgatgtgtggagcgacggagagcggtaaccaccaaacaaagtgtttgtgcaagcaataatcaacaaaacaccacctagatctaatctaggaaactagtgagaaacacaatacacaatcacaagataaacaaggagagggaagaagaaaacaaaagcaccaagagattgttcactcagttcggtccaaacttgacctactctggaggagagattgtactctccaatccactatcaaatgagttcttacaaaaaaagggatacaaaaggttacaagaaattagcttgacaagttcactatgaacaaaccctaatttctacccttttcccaatctcaccaagacactcaatgattctctctttgcaaggtgtttcccatgttttcaacccaagagatactctaatcaaagaaccctaaaccctagagttgctccctttgattccccaagtctctctctctcttccaactctctcttcaaatctgcacaagaacactttatactagccttcctctgttgaaatcgtgtcacgattttcccaatcgtgtcacgatctgcgtaccacccaagaaacgaccagtccttatcaaggatacttaacgagcaagtttcacgatcgtgtcacgattttcccaaatcgtgtcacgaatttgcaccctgcaacctagctcacggcaccccgaaatcgtgtcacgatttccctgttcttccagaccacaaatttgaagacaatctcaacaatgttcttcacattagagctacaggttttcatactaatagagctacagtttttcatactaaaatggccagaaaaagtaccagacgtcaacctcattaaatggatagcaaaatttaaaactaaagtaaagttgttgtagctcatacaacactaatatcattgtaaggcatacatgcaacacataaaatcaaataaaaaacagaacagatgaaaggtgtagctcataaatcaaaactcttcggctatcttcagaattcagataggtgaagtctcaaggttttcaacagataaatgcccaacagtggaagcagaacaaatattatcttccctctatgtttggttaccattccataattacagctattattagatcagttagaatgataatatctgctgtcgtactattttttttttctttttcataagataaagggggtcttctttttagaatctactaagtctaatcatcggtaaatgtagtcatacaagattcacaaaaagaaatagttaatcaccagcagctgaagtgaaccgaatcactttaacattcttagggtgtgtctgtgagttggattatagaggggaagctttggagggccaagtctacatcttaatatgtactatttgatatttaatttttttctttaagaacaacatatgatacatgatcatataatatcatattgttcttttaatttttgtttttttaatatcaaatacacatccttagccgtccccttcgaaaaccaactagcaaacacacccttagcacttgcataagtgaaaaacatgaagcatatttccaatgattaacataacactgatagtatgtgttattttgaaattagcatgacaaatcgtatatgtttgaaacctatagtaacatacataatcaacctttgccaccataaaattgatttgatagcatcagcatgaaaaatcaaatctagaaaacaaggtgaacatgaaatattgtattaatcaaagtgcaataaaaataaagaatacattatacagacttatttactgaattgatgaacatgtaaaactaagaaaaacagtaaaaatgtaatcgaattgaaaagggagtatctattaatcataagaaggagaagaaattgaacttacagagtaaaacctctgcatttcagcagaattgaggtcggaaagatccattgagaacgagcgattgaggagagaaaggaattctagtgataaatctcgcaaaaaccctaatgaatgaaacacaatgactatagaaatagaaaaccctaaacttaaggaaaaagaagaaaaaagaaaaaagatggcttgttcagcgggtctcagttattaatgggccgattgcttggatgttaaacatggcccaaatcatcgcctagcttgaaaaacatttttttttaaaataaaacatgtttttttatcccacttaatcgcttctcacactctacaacatctcgatttttttttttttttagaagcacaacatcttgaattatataatctgaaagctctacaaatacgtccgacaccttataatattttcaattatataatttgaaccatatatgaatggtgggagaagactccgtcattttttactttacactttagattaaaaaaaaaattgaaggaactttggataatttagaaggtcaaattctaacaaaattgaaataaaataaaatagctttcaaacaattgaatcttctatgattttaaaaaactcaaaatttaaattttctaaaacgtatttttattgtggcatatatatacttttgttttatgaattttgacttttcttttttatagaagagttagttaagttcgaatagtggtttagtcatggttgtcctatcatggctaaattttataagttggaaaataagattcaaattgttcatgacagttgtgttttatgaaattccatataaataaaaacttgaatttgtgagaattaatttctttttttgacaaattcaaatttgagtttctggaatttcgaaattcttttttaaacgaaggttttgccaaaagtcaaacagtcaaatgtggctaagttttaaaaattgaaaaaaagaaaaagtcataccggacaatttattttttacaaaacattgtgggaatatgtgtgagaataaatgggtatttatttttggacaggcttctaagaagaagaagaaaaaatcttaactttgcaatttttaggaaaaagtaattgttaatttgaagtttgatcgaaagataagaaaaatttgactatgaattattgaaaaaatgtatcagtaagctgtttatcggtgtttttggcaaataataggattagttttgattattacaagaacgatcaacctagaaatcgtaggatatgttgtgcaatctttttccagaaaatatatatatgttcatcatattcataggttgctttatgattatgaacaagatgaagaaaaatgattattcaaacaaaaaaaatgaagaaaactgttttttgtacaaagataatagtctttccacataaatcaatgtaaaaaatgcaagtaaaagacttaaaagtttaaacgcaaaaaacttaaataaaagtaaattgcattgcattaaagtagatgtggttcgacaaatcagattacatacattttgtgacttttctcaggacactgctattttgagtgctagaattatataagtgatttgtgacccttttttcttatgaaaaactactatatatacatagaagaaataattgcaaaactaaattgctaagaactacgtttctacggacccaggaattttaagtagtgtaggccatataaatataagtaaataattatttaaccatccatcttccatataattttgcatccaattctcgtaaatactcataataaagaaaactatttcattagttgcagttgccatgttttctggtggaatgaggcatgcaatttgggaattgagatatacactatttggtttttagtttattgtaaaattacatggttcatctcttaatttaattttaggtaacactttcgtccttcatctttttttcgtcccaatttagtcctttttgttataaaatgataacaccttatcggtttttatgagatttttcaatataatctgatttttcaggtttgtatgatgaagatttgaatttgtttatgagtttgataaattgttttgtagtatttgatttttggcttaaatatgcttttcatccctgtaattataggccgtttgatttttcatccctgaacttactaatccttccattttgcccctgtaattactaatcatttgaaagttcgtccctcttcccggataatcactgccacgtcatcaaattagcaaaatgacatgggaatggacaaaaatacccctggcttatttttaaaaatttaaaaatctgaaaaaaaaattaaaaaatataattttttgaaatatgaaaaaaatataaaattatataattttttaaaatctgaatatataatttcgaaaattattaaaaaatctgatttttttaaaaatcataataataatttcgaaaaaatttacaattatataattttaaaaaatatattttttgaaatatgaaaaaaaatggaaaattatatattttttttaaaatcagaatatataatttcgaaaattattaaaaaatctgatttttttaaaaaatcagaatattaatttcgaaaaaatctgattatatattttttaaaattatgtgaaaaattatttcattttttttcgaaaaagttattttcaaaatatttttagaatttttttattttttaaaattattttcagattttttaatttataaaaacaattttcagaattttaaaaataagccaggggtatttttgtcaattcccatgccattttgctaatttgatgacgtggcagtgattatccgggaagagggacgaactttcaaatgattagtaattacaggggcaaaatggaaggattagtaaattcagggatgaaaaatcaaacggcctataattacagggatgaaaagcatattttcccttgattttttttcataaaaaaggacaattatgttgatattttataacataaaggactaaatcggaactaaattgttacctaaaattaagttaagaaacaaattttgtctaattttattgtagtttattaaatgtaagttttttatcattcatcaatggagtagtatatataggtaaaaaaatgttgaaaaagtagtgagggccttggccctcaaatgggtttgacgtgggtccgtccctgccttccatgtgtctggacacttgaaaccaacttctttactaaattaattgtctgtcgaattgtggtttctacataatgctctcggtatatgtcgaactcatcaactccaatcatggacttagtgaattttgcaactttgaacattatttttcttgtggattatacacaagataaaatacagtccaacataagcaaaaaagatatttgattcatatcaagatttaaatttgttttgattatcttaataaacgcattcaatattaaataattatattattttcataatttcaaaaactatattattctcattatttcttcttgtattatacatttcgaaacaatgaaattttgaaacatgttgattatttttctttatttttgacaattgtagattatttttcttattaacacaagtctatttcaaatagtacgtttttatattctttagtatatgggagttaagaacaataattttcacagtattctttaaagtcacattcattgaccaagtttcttatgcactaagcataaattgccttttctgattaggtaaagaaagcacatcaaactttggaaaattaagaataaaaagatcatgtgacagaaattaaaagagaaagggtcaaaaaccagataaaatgagaatattgattggttagatgcattaagaaagagaggtgagacccatgtatagaactacaagacacccatttaaaggattaccacctacaaagtgcattgcttttgttgctgctgttaagcaatggattcaaccttatataagatatacacatatatagagacttttatattcttttcaattttctagtgagggagtgaatctttcaaaaatctttagttaagtgggaataaaaagaaaactcttgaaagcaagttccagtaagcaacatcttcttagtgaagtaaaggaccaaacttaagtttttttttctttacagccacagaaaagaatctgtttatcatacatacagttgactatacctattggtttagcttttatttatgaaagaatattgatattccattctctgttagtccaaattcgattctccaactactttacaaaacaagaaaataaatttctatatttattcacaaaaagtgattaggcaaattcatccctaaaagcgccggtatcaatcaaaatagtccatgatttttgcaaatgcaactgcaaacattactctctcgagtcgggtagaactgagagttaacactgttgcatttaaacttaagatgatgtttgccaatcgacttatacatcctaaaattgtaaatcgttggtcaaaataatcaatctatcagtgttagagattatagagacattaaccaaataagttccctccgtgttaatagttaatcattcgttcgagtttgaagtgacttccaacttgttaacctttaagtcaaaccaattgagttatccaacccaaataatatcaactttggaactcgaacttttgcgaccaaccagtaaatcaaaacgttaacagccactgcaccacttagcacattaataaaatgggacaatttatttttgttaatatggcttatatcaaaaagaaaagaaaaaaatgtttcaagaaaaaaagaaaaagaagcttcatctttagaaacacctgcaggagacatgtatgtaaacggctgagtcatctatccactaataattgaaattcataaataaataaaaatatatataggagagaaaacctttgtcaaaaaaagaatatataggagaaagccaaattaatttaatacagtacaaatccaccaagtcacaaaggtatcttaaaattgcgtggatattctttaatattaatttgttaatcataaaattttagaccagtaagcattgtctcctttatatgtttctcattctcaacctgttatatataaatacactcatgcaagtatatacatattcgttaaagtgcctatcttcagcctcatactcaaaccgatcaaaatcaagagtttgaggagaaagttttaagcaaatggaaaagctgaattttgtgaaaaatggagtaagcaaattgcctcctggtttttgttttcagccaacggacgaagagcttgtctttcattacttgaaatgtaagatcttctcttatcaattgcctgcttccattattcctgagatcaatgtctgcaagtttgatccttgggatttgccaggtacttagcaaactaggcacaacataatcatgctacttttgtgctttataacataatgtgatagatagatgttaatacaaaaatgatataatatatagcaatatataaataatttggttaaatattttatgtgtgtgtgtgtgtgtgtgtgtgtgattaggaaattgtggtgagcaagataagtatttcttcagcagcaaggaagccaagtatcgaaatagcaatcgcatgaacagaacaaccagctctggttattggaaggcaacaggatcagacaagaaagttagtgtttcttcatcactaagtaatggaatcgcgggaataagaaaaagtcttgtattttatcaaggaaaatctccaaatggatctcgaactcattggatcatgcatgaatatcgcctagttagcttaggaactaccgcttgcaatcaggtaattaatattccattaatcatatatgtagtcttttttacaaccaaagtgacaatgaccaaattggagtagatcgtggcagcaaagtcactgtcacttataatggcttatctgttaaaacttgttgaatgttgggtgcagttgcagaactatgcaaacgagatagggaattgggttttgtgtcgtatattcacaaagaaaagaagtaatatagaaaacggttacatgatgaagagcaatatagtgatgaatactaatgttgaggtagctcagccaagattctttgattttatgagggtacacaacttagcttcggaccctactactcatttttctatatcgtcgtcttgttcgagttccagtgaggtctcttcatcagaagaacgatgcagcgatatatatactgatttttagttacattccttttatctgcaaagttaattgtttatgtctattgaggaaaatggatcacatgcttgagaattgttactctgatttgctcctataaagaagttattggaatgcctcgcaagaggatccactccatacttattccatatacaacattaattttgaccagcagatttttaagtttgtctatagtatagtactatttataatttacataaatcagttctgtatacatacatattatatagattgctgaaatacaggatagagggagagtctataaactattggttctgttctgatcttttggatcacgaacgcttaaatttggacaataaagtctaatctgtaaacactgcacaaatttggtaaagtgttccaacatgatattagagcttaatgcttaattaacagttttgatggaccgactaaaatattaattcaattgtgctcgagggaaaatgttgaaaaactaagttcgatatcgaatataacttaaagggctaaaatggaattataagcatccgaactagtgtctatatgtttaaacaaatgctttaaaaattggatcggtcatcgaactagtagcatccttgagtcacggttcaaacaatgatgcaaccgaaatcaatccaaccgtgctagcccgcttccatctcataaatacagtatatatttttaacataataacttctcactaaaaagcataatatttttctgattatagcgtgatccaaatttggtaaatctcattcatatgaacccttggtcctaattcacaatctaatatgtactaacaatagtatatagaatattttacttcaaaaaaaaatagtatatagaatattcaaaagtgattatacatggttaacttatatggcaaggtaagggtaatttagtagagtatttatgataataagacgcttaatttgtggtaattaaaaaatgttaaaatattattacaaaaaaaggatatgcattatgaaaatttattattttgctgcattattcatctttattttgaggggtatattatacatcttttgttgttgtattttaaaaatgataatatgacataaaaaaaaaaaaaaaaaaaaaagagtctccaattaaatgtcaaggttaaatttctgtaaaaaaaaaaaatgaatgtaaatttaatttataccgaaaacttatcactaaactcatttaaattaaagtgataatatattggctcaaacaataaaataaaatccctattaactcatttgaagaaaaatatctgtcctaaatttccctgtcataagagtgtttaattttatgaagaccaaaaataacaaaaagatttggtatattctatttgtgtgcgagtaaaaggaggagtaagccttatttagagaaaattgacagataagtaatagaaccaagtttgaggctgtggctttatgttacagtttactgttaacttgtacaggacatgttgtgttggtgttttatctaaagttgacactttccaaattccaacaataaagataacgtgacagacaagcaacatataaatggatcaattacttatcttaatctataattgagcatcaacacctgtaaacacagactgtatctagttacttatcttaatcttcaactgtcacattctcaaaaccccttcataaccccccatcttttttactttcaattcaaccttgtaaaccaatccaaagaattttattttattgctactatttttcatattattttcccaccctgcaccctcttcaacattgcagggtatacagcttatatataattaattcattcatcgacttatattcataatttcaacatcattaattgtatcttgatcccttaataatgggaggcaacaattctagatcggttaatccaaatggagaagatgtattgcctgcaagacttcgtcctcttcttcgacaacgtattgaagagtttagaaaacgtaggaatgcacgaagagatggcgctgtctccaagaaggagcttctaaaagatgatgccggaaataatgatgatccgtcttctaatgtaaatgaagttttggaagaaactcaacagcatgaagaggagaaaacaacagtacatgctgtgtccgtagaaaaactctctcaagtcgctccattgcctgtttctgaatgtggaattgaggaggaggagcataaaggaagcaaagatcacgacctagaaaaatgtaaagaaattgaaaggaatgtagctgaggtaaagattgcagcatcattacaagaaaataaatatgaagaatctaatgaaaaacatgatgatgaggacaagaaggaggaggaggaagacgaagaggaagacgagaatgaaattggaagacttataggtcctggatcgccaagttttagaatatattacattgaggccacggagagaaaagagcaagcattacgtgatacgcgtgtaaatgacaaacaacaaggtgagaaagaggatgaacctattgtcgtgcactacaagtcacacagttgtgaaagtgatgaaagtgtgacatctgaatcagagaacactgacaactcaaacgaggtaattaaatcgttttcagttcatttgattgatttccctaccctataatctatatgtttagttataagcatgaggcaatgtaacccatttggggttggcctagtcgttggcttgggatcttggagtttgctcctccagatgtctcagtttcgattccctctggtgccaatttcggtgggctaagtccatacggagcttgctctggctttaaacggggcccccgcaagtgggcggtgggattggtcccctcggattagttgactcttggatcggataccgagttttcaaaaaaaaaaagtgtgaggcaatgtgatgcataagtaaaagacatttcaccttataaaccagttttgtatgattgagttagacgcaattctaaatattcaaaacaataatatacattatcaagattttgatctcaattagtctctattatttgattattcaggttgttgaaatcgaaacagctcctaagaaaaaaggacatcataagagaaggaaattggtggcgatgaagaagaatctactcaacgttaagaatctgcagaagaatagcatgaacaaaatgatggcctgcgctggcaatgatagaagaaaacttcttgcggatcattgattaatacattagttgctgctagaacgaatgttgaagacacattaattatataataacttagaaataagtgtttctttgtttgggaatttctaggcattttttggttcaatttcttctgaatccacatatactggtagctaaatgtatgtaatactatttgatcatatttagaataatgcaaccagattgcctttatagcaaacttcaaaatagtctatcttattcttatgagatacacttggttggtccacaagcctaaataaaattcatttagatgtacacacataaagtatatatattgattaattcttctctttttcatttatgtgtgtatgtctaaatgaatttatttttcgtctcatagaaaaaaggtggcactttttcgtgcctataaaattttttaggttgattaatccaagcagaggaaatttattgtttccaagacttcgtcgtattcttcgatatcatatcgaagagtttagaaaacgtaggaatgcaagagcagaatttgaagagtttaaggtctaccaatctatgtcaaacattttttttgactgaaattatgaaaccaaaacagttttttttttttgttttgaggaagaaacaaatacagttgcattgcaagagtgtatgaccaattattattttaatcataaaaaactacaaaactaagactaaaacaatactcaaggggttgatattaggcgaagatgtttaacaattcattaaaaaaaaaatatatcatcaagtaatgcctagaaatgcaaaaaattagattgaaaagtgaactgcttcatgacttaaccagcattcaaaagaactacaactctttggtggtggtggtaatttgattgtagtgatgattctcattccctttctgtatcattgagtagcttctttcatttggggaaattctgcataaagtggaagaataaatttatttgtcatatgagaaaaggaattggaaagaaaattaaacaccaattaatcctactttgagatgttgaacaatttgtgttgtctttatctgtctccctgaagatatgaacttggaaagtcatattagtactaagaatgagctcaaagttgcaagcatcgccaactttcaagttattgtcttttgcgaatgtcttccatccacttgagagttcaaatcttagtcctgtgtgggacatcctgattcggtactttgcaggccaaactctgccatttgacagttgaaaatgaatatctcctcgcttcttattcaaatcaaagtgtctcttaccgaacatagatggtatagtctgccaagcaaaagaaaaggcaaatgttaaagaataaaacactgacatgttattgtatacatactctttaaattattcttaaatgaccaatatatatttcttaatggagaaagatttggttgttgatgttgttggttatcaacttaattatgttttaagagccaaatgtttctttgcaacttaccagaagaaaatggtgctcaacgtatgatgcacccatgacaacaacaaaggatggattacatgttttgaaagattttgctctttcaagtgttgtaactttatcagcatcaacaatcactggttttcctgcaaaatcggaatggaacaccataaagtagatatttagttgtaattttttgtttataaaaattggttttagttttagttaaaaggggattgattgtgaagtggtttatgtttacgtacaagtgagttgaacaataaatttgagcgtaaaattcactcttggattcaaaagatacaaattcttgcttaagttacaaccaattctgagacaaagtcaatttcaatcaacgtcattgagctgaacgtgaaattgtttatgtgtagatacattcgcctaaaaatgagttgaataataaagttgagtgcatagatcatctttggattcaaattatgtcagtcattttccacatggttatactagagttaacatgaagtacatgccatttaaaaatgataacatgaattgaagagaacaaaacaaataacttatgcgaagcattcacaagacaatgaagacacaaaatctcatacctttaccctttctgtcaatatgatgtacggctgccttttgaaatttccgaacattaacacagctactgcttccaatttcaaaggaggagttagtttttctcttttgacttgctctacaatcttcattatttgaaggtttttttccttgacagttgaagacccttttatcttcaactcttgtcaaagggtaatttatctctaaggcactcttatcaaagatgtgcacatgaaaaagggaagttctttcatatttaaaaagcaggagatggccatgagctagagaatgatactctgcaaattctttccatcccttttgaaaccatattttgccatcactttttaccaaatttaatttccaatttacaccatttggagtctttacacatatagttttcggtaagcattctccatatttctccacaaactttcttggcatcatctgctaatcaattaaaccaggttaatatgtatgatactgctcataaaattttgtaccgctactttagacaatatttaccaaggttgcatagtttatgagctaaattagagaaattgtgatagtttagacacactaaattgaaagtatattaaaaaacataaaaaggttgcattaagttctcttcaagcttctgtcaaaaaagaaatctcttcaagcaagacacgaatttacatcatcattatgttataagatatataaaaacagaaactacaggaacaatctataactcaaattggcttacaagctttccatgatgaaggttttgagtaagtatgatcttgaagaagtgaactggcttcgctcgaggaattttgttagccattaagaagtagcttaacataaaagtataaaaccttatgaatgactgagtagtgagtactgtctataatgaagtttagattgacaataaaagcaaagaggaatactaaactatggcttttcacattccatattagggaaactgagtgaggagtgtgacactcttttttattttgtggtggcatttgaaatttgagattgattcgtaaactcttgtgtagcctgtactaccctagctactcttttctgcaaaccaaagctcagggcttcttggaagttggaacaagtaatcgaaagtcacattaaaagtgattaaatgatttccaatgaattgcatattatatgcagagaccgggttcgaacctcatgcactccatatttaaattatgtgagctctagccaataggctcctatttttttggacagatttaaggcaaagaagatcaatgtcattcatgacttaatttgaatggttggtagaaaaatgttactctctccgtcccataataattgaattatttgaaaaaaaaattgactattttcacttttcaatacaataataattttttttaggctaaaatatgtttttaatccctgcaaatatagcaagtttgggttttggtccctggtaaaaaaaaattttgaaatccatccctgcaaaattttttgttttttaaaatagtcattgaccccactttcttgcttatttggcacattttggtctaggtgacagttgatgactgtacaatcaagtacatgtgacaattattttattttaacttttaaaaaaatcagaaaatatatttatggaataaaaaatgtttattttaatttattaaaaacaacatatcccttctacttcaccctcctcttcttcttcgcagatctttctgctttcctcttcttcgccagccattcaaaccttcatcaattcatcttctttaaattaagattctagaaaacgaaattcatcttcttcaaatcaaaatcattcatgttctcaaattcatccaaatcaaaagtctggaaacacagtgttggtcgaaatcggaaaagaagatgaagttcaaagaggttgaaatcaaaatcaaaattctgaaaaacgcaagattgaggatgaattgaagatctgcatcgaaaaagaggaagaaaagggaaaaatctaaaaccctagaagttttcccctattatgattttggggtttgggatgaagttcatgatgaatttctgaattcaggattgggtttggcactgctttttcagtagaaacaaaaaaatcaatgagaaatattgttgaaatgggaaaacaacccatttgggtttgaagaagatgaacagggggaataagaagaagaacaaccacgattaagaagatgaacacaaatttgatgttactgaagactagtcgctgttgaatgaactctacattaatactgttaaaattttagtgttatttcaggaatatggtggtcagaaagagaggaatatagtggttacaaggagaaaagatgaacactttgtgtggagaaaagatgatggagagatctgatgaaatcaacaaattaattaacagatatgaaggagagattctttcaaaaaaataaatgttttatttttaatgtaaatatatattttttatttcaaaaataattattctgatttttgaaaatgtttttaaatatttaaaatatagcaatcatgtctgtgccacgtgtacacaattaaacaatcaacaattgccacataggcaaaaattggacaaatcatcaagaaagtgggtatagggactatttcaaaaaacaaaaaattttgcagggatggatttcaaaaaaaaaaattaccagggaccaaaactcaaactcgctatatttgcagggatcaaaaacatattttagctttttttttaattataattttattctattttgcatttatgataagaatgaatgaatcaatatttgataaaatactcaaaactatctttctctctttcacttgtacattttttcttaatatgtgtgaaatgaaccaaaaacttaaaatgggacgtaggagtaactagtgtcgttggttaaggaatcaaatattgtaaaacttttttgaaaggtgtgtgacaatgtgtcaatttctctcataatcaatcattctctctcatcaaaattaatttattcatagaacatcctctttcatcaaaatacactaaaagcattcacatatatgtcatctatatgtgtggtataaatgggtcacaccgaatacattatattatttcacacttctcaatcatttaaaccactaaactagcattttctaaatattcataccacccatccaaaactcaaaattgcgttccacttaatcacacaatacacctcaaatttatagtttaaaatcaaaagtaggaaagagacagtggtattgcagtaccaccacatttgttggacaaagtgaaaatatatgacacactgtcataaatatccgcaaagacactctaaaaaggaaccaatatttatgctctaatgtcagcgatgtcacggaactcaatgtcaccaaaatattttctcttattcacacattgagagaaactaccatgcgctcgctagcttgctaaacaataaagaaaattgcttttttgacattgaatatttcctattgacacaagtaaatgaccaaatcacactcagcggaagttaagtgcctctggcatatgcgccagcagttaactgccgctggctcctccagacgaagttaactgccgctggctttgctgctttttattatgattttacgcgtttcggtcgaaaaatcaaaataaatcgaaagttattaagaattctacgaaactttacaaacacctctataaaaatacatatagatgatgtgcaaagtttcgtagcatttcgactaagtctcgatttattttgatttttcgaccgaaccatgcaaaatcgcaatttttttcaagtgcgagtccgaaaaaagtgtcctagaggttgaaatttttcatgcttttttgcactcatgtttagaacaaaaaaataacatctcccacaaaaaaatttgaacttttcgacaagggacggattaaatatgaatttttaacgcgtctaaaatttaagacacgaaaacatcaaaacatcaacctaaaaattgaattttgagctgtttttttgcagacacctctataaaaatacatatagaggatctgcaaattttattagtatttcgagtaatcctgaatttattttgaattttttactaaaacgtgtaaaattgcaatatttttccaactgcgcgtccggaaaagttatatagagattaaatttttcattattttttgtacacatattaagaacataaaaaaaaaaacatttcctgcaaaaaattataatttttcgataagggatggattaaatatgaatttttaatgcgccaataactcaaaaaaccaaaacatcaaaacgtcgacctagaaattgaattttgatatggttttttgcagacaactcgaaaaaaaatatagaaagggtctgtaaagtttcgtagaattctgaataagtttcgatttattttgatttttcgaccgaaacgcgtaaaatcacaataaaaagcagcaaagtagaaggagccggcgacagttaactatcgacgtatatgccagaggcagttaactaccgttgtgaataatttgatcattttcttatatcaataggaagtattgaatgtcaaaaaagcaattttcaacaataaacatgaagtcaatgttaatcatcttctaacgttgtgcaactatcttgctcatcaaatttctctagagctgtatgtggattttgctaaagtaattgaacatttaattccataactttttttctattttgaggaaatttcattcagcaattttcttaatgttatttctttctcaaagtttgttgttttacctaaaattagtcacaaagaaaaagatctctaaacaaaaaaaaatacaccaagcactcactaccacttctattattactactactactactactaaaaagtgaaaagtagcaacgaaacgggtttttattcttagcttcttctgtaccgcaccccacacaaaggtgagtcacaaaccgcttcttctccttctcattcacattcatatttcttcaacacacacaataccgtatactctttgaattgctaggaatttctagggttcagtgattgttttcagattgaagaagatggtggactttgctcgcgtgcagaaggagcttgccgattgccgcaaagacgctgaaggatccggtattcgggttgccctcaaaagcgataaccttgttaacttgatcggaaccattcctggtcccaccggaactccatatgatggtggtgtttttcagattgatatcacattacccggtattgaaatatccccaattattgtttttttaatcagggttagctagggtttttcatttcttcacctggatcgttaattattgcttgtaatacggttaattaattattttttattattattaattattaatgactttacttttgttgcagatggatacccctttgaacctccaaagatgaggttttcaactaaagtctggtatgaaaatgtctcttactctctcttttgtcattaatttatgagtggaccggtttggataaacaactaatttttgcagcttataggataaacgcatatcatgataagtgtttttctatatcaaaagataaaatcaaaaagttaaattgttttcttacaagctataagctattttcataagctctcttggaaaattggtgaaaataaggtgaaaacagcttatgaacaatgccgtaagttgttttcataagttctctcaaccagtctcactaaacttatgtcagtaagttatctcaaataagccaattcaaagtgtgacgatggagtatgtgatgggcagtgttatctatgcaattcagtgaactggcggctagctgaaatcagctgccacaacctattgaaatctctgtaattatgttgatctattgtaatatttatctttgtatttcattgatgtctactatgttttattctttgttttcctttttagttgaaatgtttttaccaataacaacaaaaaagccacatgttgaaagggaaatgatatttataacgacaaatgtgatcatggaatgaatcacgaaggcataagtgaaacgtggcaaaatattaatgctaaatagtagtgcttccccaaacgtgttttcctgccaaaagagatgtcgattggttgcctagaaaccatgtaccttttgtgagacagtttgtcgtgatatatagcagttctcttgttgaaaacgtgaaacgagatgaaaaatgattttttttttttgttattgttgtaattaacagtgttagcatatcaactgtacatatatagttatataaacaaaccaaactcacccttataatttgttagtgtttaaaactcattgcaatttgttgcttgacatgctgttactttcgttgaaatttatagtgtaatcccagaatatagtttgggtttgatttgaaagataagctcatcttagaccaatatgtcatcctgtagatgagagaaatgctagggttatcttcatctttgttactcccactaaactgtctcttcttcacacaaattcatctgtcaaaaggcatcagttaattgaaatgtccgatacaaagcgagatctggaagatattgcccctgttaaccctcaaagttacaaaaaaattactttgaaacaatttaggaaatgaaatctggaaaatgtacccatatcaagaacatcatagaaccaaaacatacccagatcaataatctcatagaacccaactcgaaaacaatttaggaaatgagatctgaaaaatcctacaacatactcgaagtgcgagcgcccctttccaggttatgatttattccggcaacggcaaccttgggtttctgtttcatattgttgttgtttatctattacacaaaattgaagtttgatgttgttgattattgtgcaaaacgtttgctctaatttcttgtgaactgttgagattttgttgttgctgctatgtagtgcagaatgagggaaaaacaaaggaaagttaaattcagaaaattgtgtaaaaaatgagcaaaacttgattgttagtgtcacaaaaataaaataataaatgaagaaccagaatgctcataagaaggtggaaagagaaaaaggcagcaagaaagacgttgaaaaaaaagtgtaactttttttattttttttattttttttaacttgcagcaacctgtagaaccggttattaggtaaatgaataaaaagagtggatgatgtggctaattatcattggagtatgttataggagtgagttagggagtgtgtccctagcatttctcgagtagatgatattggacaattgtagtgacattttatgctagatgttcgatctgtcttgatttaattactgaatgagtgtaagctctaaacctattagagtaacatgatatgcccatctttttcattagttttttttttgttgttgtctttgtcgtgtaatgtggttttggtctcaaaatattgacagagttttgtatgtcatcttttcttaatctttccctttcaccgtctctcgttgattaccaaattcgccgattatgtttcttgtgcttgtttcatttgcctcatcattcggtgtccaagcttgttaagaaacgtatgattatttagtctattttctattctagcctttatagtatgagcaattacttatgcatagcaaatatggcatttaaatacattactgttcaacaaatatctattcgattgattaattttgtgatgcatttaaccattgtaggcacccaaatatcagcagccaaaatggtgctatttgcctggacatcttgaaagatcagtggagcccggcacttactctgaagactgcactactttccgtgcaagcacttctttctgctcctcaacctgatgatcctcaagatgctgttgtggcacagcaggtctgattcattcttatgaactgcttcttctcatatgttgtgtgttgaactaacaaagacagtacacctaagaatgtcatgcttgtccaagtttctgctagatcaacttctactggcagtgcatatttttatcgattatgtcattctgtttaaaccagtgtgtatttatgggcaatgcagtatctgaaagactatcagacatttgtcaatactgctcgctactggacagaaagttttgccaagacatcatctcgtggggttgaagataaggtaataaacttgttgcacttaagtttctgaatgtggatgcacgtcattaagcatattttaattggtctcaccagctgattacctctttttaatatttcacagtgctcaatttttattatttacgcgggtttgttttgcacaaatgtcttgtttaagagtcaatgaatatttcgatccctaaaagtagtaagttgtataacacttaggtctttgaaagtctgtttatacgaatcagtctccaactatgccaacttctttacaaatacattcttgtcaggcaggcaacatgtggcacttgtgtgctatgtcaactactccctccggtccttattataagcaacaaaaccaaaaaacatcaaaaccaatgcattcattgattaatgtaactttttgaacatttttacaaatataccctcaaaaaattgtgaaacattaaatacacccactaatatttaaaagagaaacattaaatagggatagaaaagtcatttaagcaataactacagcttaaaagttgtgacattttcttataaataggaccaaaaaaaaatttgaaaattttcttatattaaggaccggagggagtattacgttacaccttcttgactgtagttgatggaaagaaaaaaagagtttgtgaaaacaaaatagaatatatttgtgaaatttgacatattaatgactaaatggtatattcattgtctttctaatgtgtttttgttaaacatttcactaaagaaaatttgataatgatccagttaataatattgtattacaatttacaatgtgcttttatgacaattttatatgaaagcaataaacgtgcaagtttcgttcatcactgatgattttgtatcatataactttataccataattgtttttgaatatgaatcttgcattgtggcatgcatatccagtttaagagcattggtgttgtacttattatttggtttgcataaaattgtgaaatttaagttacatcagtaattattttatttccattgctaatgtacaattatgacgacgtttgtttgatgtagtttcataacacactttatttaattttgtttcaggtacagaaactggttgagatgggatttcctgaagctcaggtaaggaacattttggaagctgttggtggtgatgaaaacttggctcttgaaaggctgctgtagcttatttatgagatattgactaaaatatcttgatcattgtgaacttatttcacatgtcgacgtaagatgttggaagcacataaacaaaaagggttaattggatataaagataagttataacctattaaagatatatcgtatagtctttttggttaattctgccttttatttgctcttttgaaacattgtacccgacattgtcctaattttagagtagtaggtatgggagaaaaaaaaagtactatgaaattgattgaatccattattattggcaaggtttctacttcacggataagttcttggattttttagctttgttccaaaatataattctagtcctaaacttttccttgcggtgtgtttggttggtgagtggaggaggtaatgttttaaaaaaatttgtctctgactcaggataaaaagcaaaattgtctctgaatgtgtacctttgttagccattttagttattgacgttaaaagctgagccgacaattgttttggctaacaaggatgtatgacgtggatttacggaccaaagtggcagtaggcagttcaagattttgatccttgactcatgataaaatgcaaaatagtccctggatgtgtatctccaataaattgtttagtcattgacattaaaattgacctttaaagttgagcttacaattgttttggctgacaaggatgcatgtcgtattttgggaccaaagtgacagtaaccagttcgaaattatcagattaaatctgtaaattcatagatccctaaatcctaaaatcccaattcatccctcccaaaagtatccacaacgtcctggatcatcctataatcaagtgaaaattgattcaattagaaataagctcatagcggaaaaatgaggtatacataaaactacccaaacgaaaattgcttcaattttccaacaacttaaatgtgaaaatttattcaacattaagtatccacaatacccaaaagtataaagccatattaaagagacctaatcgtaccttcataagtgcatatgcgaagaagtattttcccctattagcatgagtttgtgcaacacgcctaacatcaattctaccacaaccacataacaatttcattgagaaaaatacaaagttcttgacgaatgagaaacacttcattgggacgagtttccaccaccacccatcatcatcatcatcatcatgtgttttgtttggtatttaatggaagattggataaggagaatggttatatattcgtttgagattttaggatttaatttgataattttgaatcggttattgtcacttggtccctagatccacgtcatacttcattgtcaaccaaaacaattgtcatctcaccttttaacgaccaattttaacgttaaggactataatggctattggaggtacacatccaatgagtattttgtattttatctcgagtcaacgaccattgtgacagcgaggagtaaagtcagggaccaaaatttcgaactggtgactgtcactttggaccctagatccacgtcatacattcttgtcagttaaaacaattgtcaagtcaacttttagcggcgaattttcactggctgacatgagtacacatctatggacgattttgcattttatcccgagtcatgaatcattgtgacagcgaagtgcaaagtccacaaagccagggacttaaaaaaaaaattatcccgatttcccattttttaacggttgaactagtttataagtatgaaataacatgttctgttaaaaaaaagtataaaataacataaaaaggatatatttaattttttcaattaaagctgcaacagtaaaattcggataaaaaaattgacatgttataagctattagttggttaaaataagttataagcttatgataaagtgatagattttaaatgagtttatttaatagagtaaatagccaattacctccctgaaattgtaagtttcgtcaattacctccatgaaattaacaaaacgtcaattatccccctgaaattgaacgttaatcaatttacctcctccgtcaaatttttctgttagtgaacatgacgttttgcaaatacccccctgaagttttgcacatgtgtgcaaaatgccccccgaacttaaaaatttatattatttcatttttttattgtggttggataaaaaaaagtggggtgaaacatggtatcaaatgtttatattttttattgtgaacttagtaatgtttgttttacacgtgcacgtgtaaattatgcgtgcactctatctttagctccagatatccttttctacgggattttccggtgacgagatagatacaatttttttcttttttaaattaaatgtgtaaccaaaaaaaaaaatgtttatatcttttcatattttttttctcactcaatttgtcctaatctatgtttggatcacatttcatattcctaagaaatcatattttcttgcaattcttctttatttttgttgatcaagtttgaatattcttgatgattatatccgcaacagcaatataaaagtttactattgtttaagttagttcataacttcttccttagatctaatcacaagtgtcctacatgtattatttataatagtgtattcttccataaaaatacaacatggttaagaaagaataaggtgaataaggttaattgtttgcctttaagaaaaaataatatagatttttaagtttggggacattttgcacataagtgtaaaacttcaggggaggtatttgcaaaacatcatgttcactaacagaaaaatttgacgaagggagtaaattgattaacgttgtgcaatttcaggagagtaattaaagttttgttaatttcatagaataattgacaaaacttacaatttcatggaggtcgttgcctatttactcttatttaataagatgaacttataagacctgaattataagctcaaatacgtggcttgtaaaacagagaatattaaattaaacttttactcaacttatacaaaaataaaataagatgaattgacttggtttacacaaaacgtaacgtgcaaaaactaggtcaagcctcgtgtgttctgcagattagaacagtcaaggtactagcggtccctccaaatatgctaataataccacaaattagatttccaactgtcacggcaagcaattttacttgatcgtattgttaaagttttttgagcaaactgatgaagttatgaaaatttaaaaacataagttttactttcattagttaatacttccactccacggttagtttattttcatgccccagcttttattctcctttaagaaaaagttaggctaaacaaattttgggagaagctctaaaaataaaaggaacttcttttatggagtactgttttaattaaagagtgaaccatcaaattcgttcttgaattttcacgggtcggccaaattcatccctcaattatgtaaaatatcaacttagttcctgaatttgtcagacgtccataaaaaatgtccctccgtccaagtgctccgttagtcatgctgacatgccgccctgcatgttgtgttgtcttgtacacgtggcaagaatgaagccacgtgttcaaggactaatttgattgaattggaaaaagtccagttttcacttttcactttatttttttctgctttccccattttgcccctgcattacccatacatccttcacattttagtcaaaacatcaaaaacatccttgaccttttacctttccgctaaaactttctccattctcacccctccaaaatcatcatctcactggcgattctgacgtttttgaagtttctatgttcggctgtgattaaaggtaacgcctttcagattgtttatcaagattctgtgttcgtatttactctggagatgcagaaactgcaggaaatgtttttgcaaatgttggacaggtgtgactcttaatttttaaggatcgttttggcaattagtatattaattgaaggactgatatgattgattatgttatgattagggaataatttgattgaatttgcaatttgagagtgttgcaccaaggaggtatgaccttagacgaccgattcctttagctgataggcctaagcagacaccaatgaggggttctgcaccagcttatccaactcatgctggcatgattagggttccatatccaacctatggtccacccggttcgactcaacctactaaattcatggagtttataccaactcccgaatttccaaagaagtgatgattactggagtttaatagatgttttggatttgtaatatttaggcttatttgaattatgccccgtagttgggtttctttttgcttaacttgccgtttaagacttatgacttgttgttaatgcctcatagttaagttgcttttgcctatgtaatttctcagacttatgacttataacctatgacttttgcctatgtaatatttcagtttcaatttgtgtgttctggcatttttacttaattttgtactcatatgcttcaatgatcaatttgatatctgattaaacaattcagaaacttatttgatggtttttaatataacgtagggatctatttgatagatagtgaaataattcagggactaatatgatggaaatattattacagaaatgtaaatgttacatttctgaatcatcttcaacctctcttcatcaccattaaacttggagcttgaaaatgaagctcgactttcataacaattttttttcccatattctcacccccttcatttcagattcaatttcaatagttttgtttcaagaaattttgtggattttggctttcagattcaatacgaaaaattagggtttcaagttttttgaattggggaagaactggaccacttattattggaggaaatttaggtgattttagaatgtagattgcagattgtgtaattagggttcaaattttatacaattggggaagacagagccgttggggaagaaaagagccgtttcggaagaaacaaaaaaaaaatctgcaaatcaatcaatttagtccttcaaaatgtttgttattatcggtcaaattagtccctacctacgtggcgcctgacatgtgagaggttaacggctacgttagccccgttaacgcttcgtttgaacagaaggactaacttgattgacatttaacaaattcagggattaaagtaatattttgcataattgagtgatgaagttgaccgatccgtaaaaattcagggacgaagttgatgattcaatcattaattaaatcaacaaatttgatcaagagcaactttaatttgatctagtctgcaccgcaagtacaacacaagtcttccaatcctgcgcaatttactttttacctcctgcttttaaacttggttgaccctcttcaaattagttatgggtatggacacttttcttttggaaaggagttttggactttttcgtaagagttttggattatttttgttctccataaataatttatgaataaattttgggtctcgttaacaattacttttagggcaccattttaagtaaataaagttacttttaaagttttaatatattgatattgaatgcaccatttttaagataaaatttctttcttaatctttttaactaaaatttgaaggtttaacgagtttgattgagttaacactcgttaaactcgaccgatttgtaatggctgacacaatattttttttttttaaagatttgtaagtgctggcataagcttaaatatgtacaattgaattttgtgggaataacatttttaataaataaaaaatgtgtattgagaataatgtgttcgagtgttttttagtcccttaaaatcttataaaatccataaaatttgaaaatcaatagtagaagaattttttattggttttatttttctttattaaaatgctataatttatttgttcattatttttatcattcatgcttgtaagtttgttttttttcccctaaaattcattgaattctttgaaattttaaaatcacataaaatccttaaaagtccgtgtgataaatcctttaaaatcttgagtgtataaagtcttttacataaaaagtcttttaaaatctcacagaatcaatacaatctcacacagtcttttaaaatcttaaagattttttttattaaaatagtcttttaaaatcctaatctaatacaccccctagacacttgttagcattttccataaattttatatattttttgcattttttttcatatgaattatagtatattaaatatattatgatagaaattaggactttgaagaaaatattttatcaaaaggctttaagtttaaaagtactttttaacgaaaatgaaaatagcaaaagctttagttcaacgattacggctctattaataaactttactctccgcttattattaaaataataagttgatttttattttttttatggtcgagattcgaactccaaaccttacatatattatgcattgtccttaccaactgagctaagctttaaccatgtaactgattatcttaataatagaaagtaccagaacacaaaaagacaatggatggaatctattttattatttatatcattttatttaaattatcaataagaaaatcagttaaattccataaaaatagaaataatccatgacaataagaggaaaaatccttttttttcttgttataataagaggaacaatctacaataataagaacaatattagacgtcataaagaaaaaccttttatggtttcttgcatattcaaagagagaatattacacacgttggtggtgttgacttgaaattttaaagtgggttcttcctcaaagtctcaaatttgattgtatttagtgataatttgagtacggtagtttaacttattaaaaaaacaaagagagaagattagacacgaataaatgacaaacaaactaaaaattgcgcctctaacgtaatattttttttaacctataaatatagggtagtatgaacccgcaaatcaacatactacgagtttattgtcaaaaacaaaatgcatagtaagttgtatttatgtaaaaaaaaattgataaattagttggtaaaaaaaggatatttatagaagatgaacatataacaattaatagaattttaagattttttctatcatcttttaaaagaaaaaaattctatcatatgcaaatttgcattaaataaaaagtcaaacataataagtttatgtttccctccaaaaaaaaaaagtttatgttaaaattttctgtgttttttgtaaggttgtacataatttttattttgaataaaaaatagtatttttttaattacctaccttaacctatgtaatattgattagaataggaaaactcttaaatttatagtgtttagtaaaattaataggtaaatgatctaataaagtaactacattttttaatatgcgtaaaaatataaaaataagtaataataaaatagggagataggttattattcgagttttctttttgttaaacaatttgttttttattagaaaaaagtactactcctttcgcctacatctataagtaatttttatttaaaaattcattgaataactaatatattaaaagagaatgctaaccagtgccttaaatgtattggttaaacaactgaaataaataagtttataataaaaagtactcaccccgtccctatatataagacccttttgtcaaaatcacgggaattaagatagtgaatatttgtattaaagttgtttgtaatcactattgtttttacaattttatcctttaagaaagaaggttagtttatgttttcaacatgttatttattgttgattgaagaaaaagatgtataataaataagggcatgtatgtaaagaaataattaatgtagttggaaataacaaaagggtcttataaaaagggacaaaaaaaattctcaaaagggtcttataattagggacggagggagtagtataattattacttggtcagttataacagcttacatttccaaaataaaatttctatttatggattacttttgttcttaggacattggttagcaagaccctatcttaaatcacatttatataaagttggcgcaaagagtaattcatcaattcgagtacgtcaaaagagagagaggggggttagttcaataaaataaaatgagtaaataggcaattacctcccctgaaattgtaagtttcgtcaattacctcctgaaattaacaaaacttcaattatcctcctgaaattacataatgttagtcaatttgccccctccgttcaatttcctccgcttagtaaaaaaaaaattgaattttttttttcacgttatgtgcaaatatccctttgaaattttgtacttatgtgcaaaatatctcataaaatttataataatcaagcaaattggaccttgacaaaaaaaatattcttttgttcccaatttttttctttatcatcatcatcatcatcaaaggcccttgttttaaaccatgatgaaggaatcaagcaaacaagttgacctgaaaaacgagatgaattgatgttctgttttgttatgtatttttgttctttttttttcttttccttttatatgttgttttagattctgttttttcaacatctgtattagtcttagactcttcttgcagactgaaagaattttgtacaaggcagcacaattcacttaagataatttactaaatttgaaaagaaaaaacagtattgataatattcatattatgttatctatgcatggtcaagtcaaattagtcatcctcatcagacatcacaaaccattctttaaagggttgtctattttgtcaccactctacatatgcacacacaagatattgcaacaagtttattttataacatattgttaggcatgcttaggtttcctttataaaatcaagttcaacatgttttagaaatttgcaaattttttttttttgtcgcaggaaccaatttgcttgattgttataaattttagggggcattttgcacataagtgcaaaatttgaagggggtatttacacataacgtaaaaaaaatccagattttttttattaaccgaggaaattgacagagggggcatattgactaacgttgtacaatttcagaggggtaattgaagttttgttaatttcagaagggtaattaacgaaacttacaatttcagagggggtaattgcatatttactcaaaataaaattggtgattttatttgtaaaaaaaataaatattggtgattttattctcaaagtttccatccaagtcctctttctccttgttttagagcaatgaatgcaaagcaagtatttactccaaatggtagaagcaatatttaatacgcagaagacggtaggtagaagtaacaacttcatgtgtcagatttttcaatcttgaattgaaaccattaactacgttcaccattggttcgtagtcccattaaatcctttcttcaatagttgcacctaaattcatcaaaagaatttcaattcaaacaacacgccataataataatcaaccataaagtcaaatatcaagaatttttagcagtagaattttgttttttctttttcctctcttttacttttaaggcaccttttttttttgttcacaaaatcaaattacgtcatgtcgttttggactttctctctcataaccaccaccattgcatttaactgacaacaccagctcagactttcagacacagtggcatctccgtaatttcatcttcttcccgtgtcttttcttaactcattctactcattacactttctcactcacaaaactttcaactaaaagttcatagcctttttcttttcttttccctctttcaactaacaaccgttactccgtcgtatctccgccgcacacgacggcgattttgtaaactaacttattttttcttctgattccatgtgatttccattttcatactctgcatccctaacagtacgttgtctcatctgacggatgggttgcgtgcttggtacgccggccagtgacggagacagagaccagcgccgtcaacgaagaactcagcagcgtaacggttcttctgaagtaactaataatgttgttagagttcgggagaggcaaaaaaatcggcataccggagattttccggtgaatctaccggcgctggagcgccggaagcctatgctcgatccgctatcagtgaatcaacaaggttggccgtcttggttgatggccgtcgccggtgaagccattggcgattggactcctcgtcgcgccaactcgtttgaaaaacttgctaaggtgaaattatacattttttgttgtgtagttaaaaaaataatgaaaaaatggatctttttgaatcggtggtgatttgtgtgtttgatttgttcagattgggcaagggacatatagtaatgtgtataaagcaaaagacttggttacagggaagatagtagcattgaaaaaagtgagatttgataatttggagccagagagtgtgaagtttatggcaagagagatacttgttttgaggaaacttgatcatccaaatgttgtaaagcttgaaggattggttacttctagaatgtcatgtagtctttatttggtatttgaatatatggaacatgatcttgctggcctttctgctggtcaaggtgttaagttcactgaacctcaggtactataattttaacctccttttggcatgcttaaattataattaaattaactgtttttttctccttttattgggtttaattacataaagttgtttcatttgatttgcattaattttgtttgtatagttttaggcttttgatcttgctcctagctcttttctaggggaagttgggacctctttttactattctaaccatatttagctttccatttatttcatgatattcataaatcaatattgtccaaacttctcacatccttgtatggtatgcgatatttttcaattacatattctctcttatggaaagaatttgacttaactaagtgttatatttcaaatattaatattttgtgtgtgttgagaagcctagtagattatttggttgttttttcttagggtagattatttggttgttaagaaaacgttttttaatttttagtcaacccctactttgaatggaaaaaagagtttgcacatcaaataggtagggcgacttcacattttatacagctgcaattgattgttaaatcaaatcatataaggcttatttcataaaaaaattagggtcttgttaacaagtgccctaagggcattgtttaaggaacccacaaaaagaaattatgtcttgaaaatacaagtcaaacatttgttaaagtcataaccgtacaatttccaatgcaaaagttgctacttttatatgcttaaacaatgcccttaaggcacttgttaacattttccaaaaaattaaccatgagacttatttcatggaaacttttgcatttagtaattgatggagtcttttgaagcagagctgctttttcaattatcagtgagactagatggaagaaagactcagtcatgttttgataaaatgttgaaagaaaacacatactgaaaggctaaattgtctctcagtattttctctatgacaggttaaatgctttatgaagcaattactttctggtcttgagcattgccacagtcgaggcgtattgcatcgcgatatcaagggttcaaatctgcttattgataatgaaggaatcctaaaaattgcagattttgggctggcaactttctataatcctaataaaaaacaaagcatgacaagcagagttgtgacactttggtatcgaccccctgagcttcttcttggagctacattttatggcgtaggtattgacctttggagtgccggttgcattttggcagagctgcttgccgggaagccaatcatgcctggccgaacagaggtattgctcttcatcttgtttatcaatcctaattgggatgcgttagatctatttttaaatatttcgagtatttgactctgtagtttgtggttgatcttgttccttaagcaacatttcttttcccgaccttttacttgaaaaattctctttgacgccaaccaagttgggtaaggtaggagcttgtttattgactaaaataaacaaagcatgttaaagagagatagattaaaaagaaataacagaaaacaagaaccattttgtttagggcagttgctatgatacttagtttcttctgtcgcaaatatttttggttagcagtctagccttctcaagtttcctttatctgccctataagatgtcttttatttttgctcttgaaatgtgtattttcagaacaatgtatgactgacttttgggttgcttggggctaggttgaacaactgcacaaaatttttaagttgtgtggctctccagctgaggaatattggcggaagcataaattgccaaacgctacaatctttaagccgcaacagccatataaacgctgtatctcagaaacattcaaggattttcctccatcttcactacctctaattgacagtcttcttgcaatagatcccgatcgccgtggaactgcctcagctgccctaaaccatgaagtaagtgatccctgtggattaaccttatatttgaaaacttagatgtaacatatttcacatctgttttctatttgcagttttttaccaccgagccctatgcttgtgaaccgtcaagtttgccaaagtatcctcctagcaaagaattggatgttaaaatgagagatgaagaagctagaaggtcgtcttattcttttttcgtatttaacttcttgactcactcatcactatgtctatttgctgagatgctttttcattttattctcaggcaaaaggcactaaatggaaaagctaatgcagtcgatggtgccaaaagagtcagagcacgtgagcgtggtcgagccattccggccccagaagccaatgcagagatccaaacaaatttagatgtaagtcaaaaatatagttatatttgtctgttatacactacttgacacttaatttttatttaatgtgccgcatatgtacacaatttggctgcagttcattttaattttaaatttctgatccttcaaccaatgttctagcatgtcacatacttttgtgaataatgaatgtctttgaccttatatgcatctaccgacatacactcatgactaatttaaaatctcactatttggtatttaatatttataaatcataatgtcacctggaacttgagacctagattcttcagcatttgtttacttgggattctctgatcttgtctaccctgacataaaatattatttttgtgattagttttttgttttcttctgatataaagacattgaactttgtgagaaattttgtttgacttgatgatgctctcatggtgaatcgagctttccactaaaatagtgtcttatattatgccttgattgagcaaacattacatgtgtatctcactgaatttcagaggtggagagttgtgacccatgcaaatgcaaaaagcaagagtgagaaatttccaccacctcatcaagatggagctgttggatatccacaagatgaatcaagtaaaggacctgtttcgtttggtgcctcggacacatcctttagttcagggacattcaatgtaaaaccatctggacctactagaagccatgatggtacaggacttcacaaaggtacaaaaactaaaaaagaagagtctcagatggcttcatcatggaaatttatgcgtccatttaagccatcaactattggactttcaatggatttattattcaggagcaaataatcagtttcatttgattttgccatcctataatgagataaaaaatgatttaggccttgatacatctttttggcatggtttccaatttttttccttgtgtttctcatattttttggtatttcatttgcataaagttgttgttgtataatcatctacaacggggattcatatatttgtatatcttaggatcaaattcactgctgtacagtttttgggagcactaattcgtcatgaccttggaaatgttcttccatttagcaagaaaatgtttatttttttaagtgctctcacgtttaatgtttcattttttatcagtttttcttttcactaaagccttggtatgcagtttcacaagtcttgtctgttgaaccaaatcataaaatttgtattattgtcttaaatgtgatcatgcttacacttcgttctattaaatctgttttccacgctctgtttcatacacatgtttctattgaaagcttcatacccgtaatttaatactgtgcacccatcttccatgatatagtcctcacttccgaccacaagagtcttcgtaattatctcagaccagtcttgtgaatagtgtattatagtatgttgtagtgtatatgtttttttatgagggtatttgtctattctaaactaaacttaagattccccaaataacaaaactaggtaaaactcaaatatgatccaacatgttcaaaacaaaacctgtaagatatgcaaggcgggtgggttcggtataaaatggacttgtaaaaatattggttcatcatgggccactttttttttatggttagattagaccatgtaccaaatcttaccatggtccactcatatcaaatctaaccccaactccacctatgtcattgcgtctctctctatctctctgtttgtctccatccaaacgagaaatggttccttacttcctttatattttttgttcttgctttgtatgaggtagaatgacccccaaagtatcaaaataccaattgcgatgtttttttttctttccagattcaaaaaattgttgattttccatcaatcctcactaaattcttttgtatgattctcaaagtatcaaaataccaattgcggatgtttttttttctttccagattcaaaaaattgttgattttccatcaatcctcactaaattcttttgtatgattctccatccacccctaagaataaaaattgttctgtagattttaacttttgaagtgttactgctacttctcactctgtagaaacattgtttgagggaataacaagtgaatagttgctgcaaaaagaattaggaagaaatacggctgttatgaaattgaaattaaacaggtcgaaattcatatcaaaagtttatctagtttggttgaaccaatgattactagtgtttgaatcatttggtaaataataattctcaatgtttgtgtaattcatatgaagtggataatttctcattaaacatgagagttgaatgaacctgtctaaaaaatactctttgttgcgttgaatgtgggtttgaggtagatcaccatgatgttcattaagatttttttcccaaaattgaagagatgtgaatggtcttccacagggaagagagagaaagtaaaggaaactttagagaaagtaaatgaatcatatgtgtgtgatgtatagtgttattgtacttacatgctaatctaatggctttaatttttggtccattatggaccaatactttcattggttcaggctaaatgccaccatgcaagggacacatattctaaacaaaaatgatccaacatgctcaaaacaaacctggtaaaatcaagtcaaatatgttaatagtaattctagatgcaacatgtcaataagtagagtttttgaattttttcagtctttaagttaaaccaatcctccgaacctacccgtatttcactggtagtagtcgatgtagcatttaaagcaagagatttactttttccaacttatggttttctcacgcgttctgtaaaattttcaaaaatgctcctttgccgttcggattatgtaattcggattgcattagcaccatgaaaaaaaagatctaaataatggaattttggattttgagggtggagtcccgtaagaagtctcttctaaaagaggtttgatcataaaaacacaagtatgaaaactagtaagattaatatcgtccttataatgactatcaatgttataaacatgttcagaattggtgatggtattgtccggattacgtaatccggattgcattagcaccatgaaaaaaagggtctaaatgatggaattttggattttgagggcggagtctcgtaagaagtcctttctaagggagtcttgatcataaaaacacaaggacaaaagctaggaagattaatattgtccttaaaatgactaaccatgttacaaacatgttcagaattggtgctcgtgctgtccggattacgtaatccagattgcatcagcaccatgaaaaaaagggtgtttggttttcagattatgtaatccgaaaaaatcatgtaacgcgccctattttttgagattttcgaattacaaaatccggaaaaatccataactcattttttcatcttttaacaaaggaaaacacaattccggattattaattccgaaaacttcaaggatatttttgaaaaaaatagggcgcgcgagaaaaaccatagggtggaaaaagtaaatcccttaaagcaatcccccaaataacacaatgaaatgtaccaacacaccatctattgattggatcaaaattaatgtcctaaattaaaagaaaattggtttttagacattcaaaacttcatattgacacttgtaaatgacatttttactctcagcggtggttaactaccgttcaaaatatacaacacaaaacaaaaaaatgctccagcggtattaactaccgtggagaagcatgtatatgatttttatgagttctcacttgtaaccacaaacacttgagaagctggaagtagtttcaactaccaattaagtaaaaatattagtactagtataaaattagttctgtttatcttttttatagtaattgaaagcaatatttatttaattagttagttgtatatgtgtactattgtgtagttatttagtttggggacaagtacagaggaagttataccttgtgccgtatattttcaattggaactatatactctcaatctcacaagaaaatataaagttataccttgtgccgtatattttctatcactagaaaaaaaagggtcactaaaaggaagttcatatatatattaactcaaatcttgtattaatcttacagacaaggcctgaagattaatctacataaaattaataactagctagctctctctctctatatatatatatactcgtaatattaatttctaagctatatatgataatatagttactagacttgagtaagatgcctgcaagtaggacaagaataatgagataacaaaaacttatcaatacaaaccacatggaaatgatgattgcatttcggcaggaaccttatctggtctccattacagaattcagctaaacaaatgacacaactaaaagttgaggatggagaacctgagtcacgagttgaggatggaattgttacactcacgctgcattaaggattccaaaaaaatcaatattcatgctctacgggtgttaaccaccgctggagtttttttttttttttttttttttttttgtgttgatagttggaacgacagttaaccaccgccggataaatccagcggttgttaattactgttggaggtaaaaatatcatttacatgtgtcaataagaaattttgaatgtcaaaaaagcaactttcaaattaaaaaacttaattacaatctcaatgtcacaagtttctacaagatcctatctttgttgcatggtgccatttaatttgggaaagaagagttcttttccaccatgggaaagttgatcatatctattagattaaatgaggaacatattcctatcatactctctcaaccactagattatttttttatattatctttcacactctctctttcatgtccccacacacccataccaccaccactaaatcacaaattcaacaaccactttgaccaccactgcaccaccacacaccaccatggttgctgccggaaaacttgttagcgtacgatttttaaaataggaagaccaaaacatcattttctttttaaatagaaagaccaaaaatgcatttaaaccttacttttttaacattttttcttttcttttctttttttatgcttccagaacccatttgtttctttatataaaaaaaaaaacagaagaaaaataatataattcaaaattatataatacaatcattttacctggagagaaacgaattaattggataaaaaaaaacacgatcacaaacatgtatagtttatgcgatggtgattggaattcgaacaacaagataattatgcatccctctaaaataaactatgaacaaaataatattgcatccctctaaaaaaatattaatataatattgcatcgttaggttaatttagattctttataggaaaatttgcaggtacccttgagttttgattaaaatgatggtgccatttaatttgggaaaggagagttctttccggcagcaaccatggtggtgtgtggtggtgcagtggtggtcaaagtggttgttgaatttgtgatttagtggtggttgtatgggtgtgtggggacatgaaagagagagtgtgaaagatagtataaaaaaataatctagtggttgagagagtatgataggaatatgttcctcatttaatctaatggacatgatcaactttcccatgatggaaaagaactctcatttcccaaattaaatggcacttgttgcattatttagtcttctctaacatatgaacatgtaattaatctcaactggttgtgcataaaactcatatctcaccactacttttaaaagcaaatattagagtaacatacttttgtgagtagtattgacagttaaaataagagtaaattacaccccactttcttctaagatgcttgaattacattaccctatctttttatgttaaaatatataatctccttccctcttattcaaaacatattagaaaactttacactctttctcctaagagaagcttgaattacattcccctcccctcttatgttaaaatctgcactttactccctcaatttttctttttatttctaataatttagcaaaaatagtaataatctaacacacttcggaaaaaaattgtattacgggtctattttaatataataaaaaattgaatacatatttttcgctattttttattcacaatttcattaacatgtagttttaaactctattataaaatatgaaacaactcaaaataaaattaaaatatgtaaaaaattactaaagaaaataaaatagggttatttgaaagttaattttatactctaaattataaaatcaatagcaaaatatttaaatttaattatcattgacatttaaattataaagaaatgaattattttttcttaaaaggtggttcaaaattaaaatatatcataaaaatatttatttatgttaaatagattaaagtgtagatcatatttaattattaagggaggggttgtaattcaagcatcttataagggaggagagtgtatattttaacataagagaggaggggagtgtaattcaagcatctttgaggggaggggggtgtaatttactcttaaaataacgaaaacaacttactaagtgagtttttttttctcatttcacaaaaatgtattagtgaagaagagagaaaaatggttttaagtgctcttgtcaagtattgggacatttactatcaacgtaaatgcaaagtagaatacattgaactaagagtgataaaagtagtattaattatagttataattgaaaaaaaaaaaaaaaattaatattgcattgaaaagtgaaatgagttagttatgttaggataatattttttttacaaaagactcacttattatgggacggatgaagtatatttaaaccacttaactatatttttcaaatatctataccactcagtccaaaatttcataattttataatgatcccactaatttcccaatatattacaaatttatatcttacattaatttaaaacaacctttgcacaaatatgaacctattaatttaaaaaaaaaaactcaagtaaaaaaatgttgacaattgcaggtaaggatacgttgccgtgtagagcaacgatgaagagtttggctaccattcttcaatgccaattatctaagacattctaacataaagacattgaatattgtggagccacgacaatatacatacgatattgatgctcctagtgccacatccaaagttggacgaaaaaatggaacaaaaagttttttttcattcgaaacctaattagagatttcattcgctctcacgtgtaatttggtaacattatcatctattatttcattctttatttttaagaaaaataaaaaatggtcatatattatttttgaagaagaaaaatgatcataccttatcatcagttttcttaatttttgtaatttggtaacatggtcgtatatattaagggaggaaagtagtatatcatccattaaaccgtgtggttgagttgaaaggactgaacggtattctttctctggtctattatgtgagattttgtggaagggtgtttttaatcatacttcatactcactcatataggtgtttttaatctgcaccattcatatatggttcaacttctttagcaatttattacttgaaaatgaatatgtaatgtgataagctaaggactaaatggtgcagattttagatgtaactaaaatagttgtatgattttgttgtgatttctgattaatagtatcatctactttctttcagttgaagggaatcaatttatttacaaagctgcttcagagttaggctaatatgatcttaactattatgatcttaaccaatatttttctcatcaataatttgaatttgatacattatagcgaactttcatctaaaactaaaagagtgctaaaatcatcaactaaatcgtattcatatctctggtgcctaaaatttacactgattgctagcttaaaaagggcacagtccccaggcaatatgcacagtccctgtcgaagatcttcgggtaaacctagattctatttgttacaaacaggaatatgatatctttgatgtaaggaacacatactctgtgtcttcaaacatataaatgaacaaaatcacacacaatagaaaatcttcattcatgcttcaaataaatagcacatgatttaaacacataataactactaacgaatcaatcattgaaagccaaacaacattacacgttttagaattagaaagcatacaccttttactaacagaaaacacacgaggccaacttgatacagttaaaagcagacagtgtaaaatgactaattcaaaatttaggatgctaaattgcaaataataatcatttacttacaaagtctgtgaggaacaagaaatgaaaactggtcagcgagatataccatattgagataaaatagtagaaattaggtgtgctcttgaagaacattaccacaattataactataattaatactactattttttcgaaaatagtggattcagtctactttcagaaacaacattgttaaaagaacatttgtttcgaaagtctaacatttagtctactttatgaaacaaactcaaatagtagaaaaactattcataaattttatctaaaatcagaaaccacagttgaagaactcaatgtgtatggagttctcatttgtcaacaatcatttaagtttcgctaaattaatttcatcgtagagcagagtggatgaagacaacatttgttttgcatttaacagagtgagtataaagctcagagtgcatcaagtgctttgaggtgtacctgtatgaagaaaaaaaaaatcatcaaattcacaaacaatacccagcattaagaaagttacacccaattaaccttctacaaagcactaattcattttgcaataaaatgtcactttctattatgtgcatgttaattttatttacagcatagacggaccacaatcatcattttacgaaagaaaactacagatactaatactattaatcattctagacagtctacttcacattcataaattggagtaataacagaagttctgaacaatctccagaatactgaatacatgaaatttgtggagacaaacattaaagcaaaagtaaataagaacataaataatcaattcttcatttaaatgtgattgaactattcttaaactgtaatcaaagccaaaatttataaagccattcttaagagagttagaaaaaatgccttgatataaaagtattgtttcctaaatcaaagggactgtgcaaaccaaattgtcaaggactaacatccaatgtacacttacactaaagtagtcatgtccaaagttttattctgtaaccaaatttaaaatttgccactttagtttgacagtttccatgtggatccttataattagaaaacgcttttaatttagctaaaaaactgattctgttatttaggagtaaattccaactcagttcctcacttttctatgatgtgtcaattcagtttcctactatcataaaatgttaagctggtctctcactttgcagaaagtttgtcaaattagtccatttgtcatgtatttgctcatcgcttggatttcatagacaccaagtatgtaatttcatggaccaagaatacgaaatttcagggacaacttgatactcagtcagtatgtaactccagtgacaactaagtgagggactgacgtgacatttcataaaagcaggggaccaaattgatacaccctataaaaataagggagcaaactggatatttactaccctatctataaccagcttgattattcattacaattacaggagtcttccatcttatttttatcaacttaaactgacaacaaattttagaaaatgaaaacaaaatatgtttttaaaaagtaaacagacacttacacttcctttgcttgtgccatttctctatacttccataccagttccactggaaacatagtgctgcaatacgcattattccagcagcaataacctcaacaaaagccattaagaatgacctctgaggggataaacctgaagttgctagggataacgcaataccctccaaattgcaagaaatgataaaactgccacttcttatgccatcaaaagctttctgagcaacttcatcggctttcataaaaccagaagaggcggcaatgattttggtgagctctggttttctcttattttctgcaaaaagaacctttcagtttgtacttacacttggattacattatagtatacataaatttaccaagagatggcacaaaatggtacttggcatgacaaaatcagataatttaggactgagctaacaatatcctacatgacaatatactatatacccaaagacacactcataacatggaagctagacttaataaaaagacaatatatattgaaatgctaacaaatcatctgtcaactgatgcagaatttgtttcacagattaaataatttcagagaagttgtacattcaagcacttccatagcaggacctgattccccatccatattgaggttgttgttaagccaaggttacttacctcattttcaatgtaaaatgaacctagatcaattatcaaaagtaatactccttatatggttgatgaaataagctcgagtatccaattaattaccttccacaagtccaggagtatccgtgtctggagggaatatcagagagacatgaatattatctcctataacctcttgttgcaatgcttctgctaaaccacggaggccaaatttactggctgaataagctacataaccataaattcccacctaaactccaaattaaaaaaataaataaaaaaccacatcactagattatctctctacatactcaaaccgaaggctattttccatcatatttacaactataggtgctactccaacacacacactctctctgtctctctaatggtgtcatttctaatcatatccagtctagtcttaccacacatccaacgcaacatcctaatctcggctaggcttactttattctcgtgttgaacaaaaaaaaaattaaactttactttatctttcgttataaaaatagcttatacacaaacacttatggtataaagtgcaaattaagctgtttatctaaatggccataatttatgggtaaaattcccaattccatacctgaccagcttgtgatgaaacaaagcaatagaagcaggtaaagtatctttcctattcttcttcatatgaggcaaagcagctttaatcatattcaaacaacccatcaaattaacatcaatcgtaaacttgacatcactcaattccaacgcataaaacactccatgattcaacaacaacacatcaatgggtccagcttcatcagccactttcttcaccgcatcaaatatccttacttcaacgccggtggcgtgtttgacggagttcttagcttcttcgagtttggtgagggatcgtgccatgatggagacacgtgcgccatcagcggcggcacggtgggcgagggcgaggccgatgccgcttgagccgccggtgatgaagacgttacggttggtgattgggatcttgatggggcgggggcggacgaggaagtagaggagggggaggaggaggagagggagaagatgaagaatgcgtccgccattgatgaagcttcgaaatcaaaatcaaaaccgattaaaatgataaagaaaaagtttgaatctgaagaattcttcaatttctatgtcactctgtaacaaaattgttattgtcgtttgtgtaagctgaagtgctctcttgctatatggcgggacagaaacaaatgtatagtatattgtaaaaatcaatttaaaaaagataaattatgttttaggtacttataaataggcgtgtttttaatattagttcttacttaaattttattaaattttttattctcaacgtttttttccgttagcaaaataggtcattgttaattgttgctgattgagcaaatggtgaagcacacgtggatgtcatatttgacgtttttttgttaggttaaatatgtttttagtccctataaaattgaggcattttaagtttagtccttacttaattttaatagttgttttagtccttacaaaaatactacgcactcagtattagtcgctgctcaattcaaatttgtttaatttatgcttaaactcttaagttttttaacaattttttatagacgtgttaagaacattattaaaagttcctccgcaaaaaatttatcgcaaaattttatttatatgtccagatttaattacttgtatctttaaaattttatcgtttttaaaaattcatatttaattcgtttcatgttaaaatattctaaattttagtaattgaacctttcaaagtgttctaaacttgtctcaataaaaccgttaaaaaatttaagagtttatggataattaaacaaactttgttttagcatggactaaatttagaagtaatttttttttttgtagggactaaaaaacctactaaaactagttacgatagtattttcatcatgaaaagatatttttgactagcaattattccaaaaaaaactatcaattcggcaacaaaaccactcatgcccgacaatgcaagagaagtcatcgataagatagtgaaaatcgtgaatatttttggcattgggatagccattccctccatttcgtcaagataaagaagacgtagtttatcataactagttcatgccaagaaaaaaagggtagcgccaataagtccatgagatattatttgtaaaacggcctcgttgagcccaatatcacttatagaaccaattcctagaattatgaaacccatatgagatacagaagaataagctattctttttttttttaaattaagttgaccaaaagatgttgaatcggcatagattatttgaatagaaccaaataccattaactaggggcaaaatattgaatgagcgtgggaaaataatttcatattaattcgaaccaacccataagctcccatttcatgcaaaactagtgacagtatacaagaatttaagcataaattgaacaaatttgaattgagcagtgactaatacttagtgcatagtatttttgtaaggactaaaacaactattaaaattaagtaaggactaaacttaaaatgcctcaattttatagggactaaaaacatatttaacccaacaaaaaaaagtcagatgtggcatccacgtgtgcttcaccgtttgctcaatcagcaacaattaacagcgatgacctattttgctaacggaaaaaaacgttggggatcaaaaatttaataaaatttaagtagggactaatgttggaaacgcacctatttataggacctaaaacataattaacccattttaaaaagttagatttttttaacaaaacttgaattttttttccgttaaaaatataaaaattcatatttaatttatgtcttggtaaatgattctaatttcttttggaagagttccttataatattatacatttttctggaaaatttgatttaaaaatataaattcgacatatgagtttacgattgaaaataaagaagaaatttttttgaaagattaaaagttgaagaattttttttataaaacgaaaagttgacatatttataggaataaaaacatatttataagatttcttagttttactttctaccattttctcataaaccaattctcattaggtttctcaaaataacaagaatatcatctaaatatgacatggagcgtaatgtcaacatgtcatatcatctaatttggatgagaaaatggaataaagactaaaactaaaatatgtccaaatgttaagggccaaaaacacaaacaacctttaaagtaaaaactaaaaacaccaaaaatatgccaaaaagtttgaaaatctaattagatttcatttgctttcacctgtaatttggtaacattatcatatatattattatttttgaagaagaaaaatgatcatatattatcatcagttttcttaattcttgtaatttggtaacatggtcgtatatattaagggaggaaagtagtttatcatccattcaaccgtggttgagttgagaggactgaaccgtattctttctttggtctatttattgcaacattgataattagattgatggtacatggtgaaatggaataaattagactaccataatataagaatgtcctaaaatgtcaacatgaaatttccatcataataaaaaaaaaacaaaaaaaaaggcatgtcaacatggctagacatatgtcatggaaagaaaaatagaaccgcaacttgttggactcaaaaacaaacacacaacacaagttgcttttttttttttccattttgcaaattgtggttttcaattcaaacaacaaaatagaaccagccagccaaaaaattctggcttagccatgccccacataaattctttgctattagaatctttttcataccaatcattatcatcatccattcaatccaacaccctacgaaaccaagatatggtaacactttccatagataacacaaaacataaaaattcctagctgatacaatacaaagtttgttctttttatcggtgaattgtataagcaagattgaattttaagcattcatatggactggcgtttgaaataaaacctctggtgagtctttttcatcataggaggatgctgcatttgtacattttgtgttttggttgttgggttttaagagataaaaataataatcatgtgcttcacaatttattttaaaatggaaataacttttggactagtggtttttcacctttggaattggttgcagggtttataagaatttaatcatttgagattctgttgaagggtgtttttaatcatactccacagtcattcatatatgattcaacttctttagcaattcattacttgaaaacgaatatgtaatgcgacaaccgacaagctaaggactaaatggtgcagattttagatgtatgattctagcatgatcttgctgtgatgtctgattaatagtaccatctactttctttctgttgaagggaatcaattcatttacaaagctgctttggtgttgagctacatggattttttaagagtatggtgaagaaggcgatttgtttttgaaaattttgaagaaacctacacctaaaatataaatggggttgccacaggtatcttcaacctaccttgctgaggaggtggcaacttcaataggcacatttgtgcaatctacacctaggaatagaattgccagcataagcaactatgagttgaaattgttggccggagaagaagaacttggcaaatgcatgcacattcatatgcctagctctgaaaaaacaaatgttctagagctttcaaaagaatcacctaattcaaatatgtgtaaagatggtaagtccaagatacagaaattgaagatcgactccacggaacaaattggtaggttatctgtcaatgctgagcaaactatgcagatacctacttctagaactgtaggttttcaaataagagcctcagctccttgcgttaatggttttcgtggaaacagatatttgccaactggagtatctgagtctaacgtcaaaaagcgattattatcacctttgaacgtgacattgttagaagataattttaaaggcgatcacctggacattggcaatgagttttatcaaaggtcttcagaggctggtgatgatactctacatgcggataagaaggttcatattagaaactacaacaatattcactctacactttggtcttcctcttgttttcatcaacttgtagattcatcatgtaatgacccaaaccaaattttaacgagtcacggccattcaaactgtgaaattgaggagccagtatcttttaaacattacaaatcatttcctgcatttaatgatttggaggattcaactaaaatgaagtcacaaacagaaacgatcttgagacttcaaaataaggcgtcatcacctcgcttccctttatctcctttgggtaaaaaaacttgtacagataaaaaattgggagaacgcagagattttgatactatgttgagtgatgtcaatctgtttactcctgataatatccttgatatgaatgagtattggactagtcctgctagctttcctcctcggcatgcaaagttatatggatcggtgaataggttgccaattagaaggtccctggtcggttcatttgaggagtcactattgtccggtcgtttaccgtctgagaaagttagtctggttggccttatttctcatatatcgtgaacctctcctggttggcattattggagtgatgtttatgttatttgactcttgttattgtttttaccaccttcaatgttgcagaaaattgaaggctttcttgctatgctgaatgtaactggaggcaatttctcacctcaatcgcgaaaagttccatttgcagtaacaagtgtggatggagacaaatacctactttattattcatcaattaatctttcaggaaagttattatcaggcaagactagagtaactaaatttcagagaaaacttagcatggatgagttgcgatatgtaaagagacgtatgcgtatacctataaaaggatgtattcaactggtattacactataagacctttaaaattgttgagttgagaatatcgttttccccctcctgtctatgagatgccatgtatatgtagctcaaaacggttaagcgtagtgtggcagacttgattcacaacctaatattttgtataatggatcattaattcattatactgtgtgttcatatgttgaatttgtgtgacaaacttactgaccaggttctcaacaatccagagagtacaccgattcacaccttcttttgcaattatgatttaagcgatatgccagccggtaccaaggtagggttgaatgaaatattgcattcaatattttgtcacgtttggtcttttctagaagttgaatttctgaacaatgtatgtttccgagctcaagtagctcttgtgtagggagcatgttagagatacaatacaatcattcatcatgtgtcacataacaactaaagctttagagagagttgggttgtgaaaatattgattgaaacctttcaaattataagactgtcttcgtatatcacttctgataagatactttaatatatagatgtttaatcaccacttcttacaagctcgtgtttaatgtgctttacttgtgtatctaagtagacgtttttgcggcaaaagatcactttaacctcgtctagatcgatgtctacaaatggaaaagaaatccaaacagattctgatactgatgctaagttctcaagaagatgccttgttgatgaagactgtgacacatttctaaatggttcttcaaagatcaacaacaattctctcaacaattgtatcatgctttatgctcttcaccttcgctttatgtgccccttgcctaagaaacattcaaggtttgttcctactcgcaattctgaccctccaccttcggaagcaagaaatcttatgcacaatgaacatgaaagaagtttctacttgtatgatgatatgagagtagtgtttcctcagcgtcactcggattctgatgagggcaaggtatgcaaaaatatacatgaaagtggttttaatgcctcatttgtttatgttacttaatgattatttcatgttgcagttgaatgtggaatatcatttcccatctaatccgaaatactttgacatcagcagctaaaatgtcaatgcatctctgtcaatggttttgtacatataattgtaaatattgtatgcatacaattcatatcttctttgagttttggggccaactgctccaatttttttttacttctagcttgtaaattacttggttgttgtccatgctgaatttttagtacttgcttcaggagtggttctgctttcaatagaaattaaatagtattatgcttgggaaggaagacaatgatcacatttaacattggaacaactaaattaatcaaaagtcaaagtggtaatcatgtttgcatcttcttatacagtatatgcagcccacaaactcctctaaagttgcattgagcttgaaatgtaacactagaagagggcatgaaaattatatagaagctagttaagggaatataacttttcttaccgagtttagggagacttcacaagcttagctgagctttataattcacaaatccacatagttcaaggaatattaggcttccactgccccttccgcgacatattggatattcataggcggagataactctttcccgccgtcaccgcctccatgtggcggtggtggcgatggagaatatggtgcatctcggtaaaatcaagtcggtcctaagatttgtaaataaaacaagaaatgagcatttagttgttatgacaaatgttattaattagttattgtattagttttttttcttcttctttgttcgagtttgaacctataacctttaatcgaacctgagaccacgaggaggagcacactcccagattttttttgatttaagatatatataaaaaataaaaaataaagggaaatagaggtttttttattaataagcttttgaatattttaggaaataagaaactttaaataaataaacttgtaaaaaaaatgttatggttgaagtttcttatttcctaaaatatttaaaagtttatctatttagtagtattaataaaataaagggaaatacaagttttatttacattaccaaagggaaatagaagttttctttacattactcattgatgaattagaggaaattactcttatcaagtaaaaatctcatcatttgtcaaaaaaaaaaattatatcaagaacatcaaactttttttttatctcttttatttaatatgtgatattcaattcattcgttacaaaatcgaatccgacctatcatcaaaggtattaaatattttagaaaataagaaactttaaataaataaacttgtaaaaaaaatcttatggttgaagtttcttatttcctaaaatatttaaaagtttatttattcagtaatattaataaaataaagggaaatacaggttttttttacattaccaaagggaaatataagttttctttacatcattcattgatgaattagaggaaattactcttatcaagtaaaaatctcatcatttgtcaaaaaaggtaaaaatcccatttcttcatctttgttattacaatcagctatcatttttatatcaagaacatcaaactttttttttttttttttatctcttttatttaatatgtgatattaaactcattcgttacaaattcgaatctcatccatcatcaaaggtaaattactacaaattcatcatggaatagtgcagatctcacttatagagttttttttttcttagaatgagtataattttcatctcaagaacattaaactttttcatctgcattcaatatgtgatatccaactcatttgttccaaaatcgaattatacttatcaataggtgtaaattgttccatagaaatctattgttatcatgatttgcgtgaaactagactcagttccttaaacaatgtctcgggcacgagccttgcctaattgtggatagtgaaatgtggttacggaggagtatctaaaaagtaaatagactctcaacagatcaataatatggttatggaggagtatctaaaatttaatttaaaacatggagaaggttaactatatatagaaaacctatctcattatttatatatagactttaaagagaagaacaactattatatcaatagttgcatcataagtaaatcataaaaatggtcaagatagaaatctaccacaaagcatatatgtttttggtaaacctgaaaactccatgagattaatcctttgcaatctgtgaatctaaaaaaaaataaaaccaaagaaatggtgagtcacaagaattcaatgggagcatgacaaacaaagtggaaaataatgggtaagtgaaaatttcaccggtctttacccaaacaatttttaaactaacaatttcatccttcgaaagctcattcacgctaaaaaataatacttgcaatagcaaagtcaatactatttgacaaaaattcttcgcatgaaccaacggttagtcatacataaaattctacagccctatcttcaaataaatatataaaaataaccatttcaaattctacagccctatcttcaaataaatatataaaaataaccatttcaacatgactaatatcatttatctcttttcactatttgtacataaaccacattatctcttcgttgtggtgaacggagatatatcacatttctctttgttgtggcgaacggaggcgaacggagatataccacattatctcttcgttgtggcgaacggagatataccacatttatcttcgttgtggcgaaagatattttctctatttttactatgagcacgtaccacataggctacattatctcttcgttgtagcaaacagagtttttacatttcttactataagtcgtacctcatgggctacattatctcttcattgtagcaaatggtgttaaaattctcattagaacattaaaacagagtttaaaaatagtgtatatcaccaaaattaattcataggattaaaaccctcataacaggttaccctataacaagttattttgaaaaatttatttgtttctcccattaaacaaatttgtattttataaaaacatgccacaaggtaatttagctactcacaactatgttgaaccggctgatatttgacccgctgccttctatggttccatttccggatttcccattgaatctcaattaccaataacttaaattatgttggcatctcataacaacaagactttcccctttcatctcatcaataatcttctctattgctctattaacacataacatgtgtatataccatgtagagacatgtttctcccaataattatttcctcctccctctgtgattgttactctctcttagaaaaaacttcctaatttctctaattttagcaacttccattatagcaaggagatcaaggttttattatttcatttcagtcatacagatggcatgcaaaaagactgaaattctagagacctgtacattttcggctggctaaagaagtatctatattttctgtattaaagaactgttctcaggatgtgaagattcccatgtaaagctgtcatcaaacataaactactgatttttgataaattgagataataatgacaacgcagcaaaagaaattaaattcaggcattcattcgcaggggtcttcaacagaaaattgtttaaagactgaaaggacaaccccagcacaggagtgtagagagtcgagggaaaaatattaaggtaggtaggtcctaatgtgttagagcaacagacaacaacaacactgcaatttgggcaatcaataaaccatatgcacatgctcaagaacaatagcacatggcactcgcaggcaattatgtcaccatccaccaaaaagacatttaggaaaatcctatggtatcaaacacttctactaatgtaatcataaactaatgaggcaaaggcaaagaaacatttaattttttatttatgaaatcagttttaagtatgatgtagacatcaaagaaatgtaaattatgataaaggataaagaagtgaccaagaaagcaattcctaatatagcaaggaggaaatatttattaagaggatcgatcacacatggttcagccaaacacgtaagagtaagatgagtagtaacctatcaatggtgatctgaatcctgggatttccactaacatgttacccacctgtgtaaaagaagttatgatttgttgatggcagatcaggcaagttatttggaactcatatgaaaacagggattggaattactctgtggtgcatcaatcaatatacagttagaaacagaagtcatagataggttcatagccattctcggctacaacagaatcaatcctatggagtatgaacaaacacaaggcattatcttctattttatgctttaattgattgatgctgaaatataaaatggagaaaaatgaaatagaatttagcattagttattaccaaatgttttttaaataaataaaaaaaaggaatagaactttatcagtccatttcattcattgtatctatgataaattttactattgctattcttttcccaatcctttcctactaccatatttgttcttgaccataatctatcctaccctattctgttctgttctggcggcatgttagatgtatctgaatcagaagataatgcaggaaagctacattgaaaatactagcattcattgatgttgaattgcacagttaaaagcaccatatcaaaatcatctatgcaataaattaactatgaactatactagtctagtacaatgcagagtcatctactctgtgatgttcctaaacataaacacaaattcccattaaataatttgacaaaactcacctccacatacaggagaaataagcataaattattagtaattacaagaaaaaaagggaaaataaagaaaacaaaaaactgaacacacctataatatcatacatacagattcagtgaaaaatcatcgattgttattgttcctgtaccatgatttagctcaatgtggatcaatctgatctctagggtcttgcaaaaactccccaaatcttaccacgaccaagtccatctaacaatttctttgaacccggaacatccaactcaacaagcttctgcatatatacacaagccccagcagccaccatttgtttccgacaagtcttcgaatgcaaaagtgaaaccagaaccgaaacagggtatttcttatccaaattaaccaaagcagggttcaatagatgaactgcactcactattcccctctcatcctttctaaagaccctcctattgaaagggtgctgcaacaacaccgacaacgccattgcagcagatctttctcctccacacctttcccatccaacatcttaatcaaagaaggaacacacccacattcccccatttcctttctcgtcttatttccaccattcaaacccatagcataaacagccctcgcggccgcaatcctcaccgttaaaacatcacaatccaacactccaatcaccctcccaacaaacccttcaccaactaaaacctcatcaattggaccagtcatagccaaatacctcaacatttcaacaccaacttcaagactctgaatcatcgtaaccgaatcccagtaattcttcaaacactcgacaccaccttccttcacagccaaaaccctcatactctcatcctccgaaatcaaattcgccacacaaccaatggcattctctcgcgccaaccccgtcccagacgaagccagccctaacaaaacaataaccgcattctcctccacaaaattctccttaatttcattaaattttgccagattcctcaaaaccgcggccgcataaccttgcgaacctggcgttccaccttgacaaatccctaacagagacgaaattccacctctagatccaatcgctctagcattatctctactcaaactcaacgcctgaagcgcaatacaagctttctctatcgctaaaccacttcccgaatccaaaaccctaaccaaatgattcaacaacaacaaaccctccgcaagtaaattattcttcccactctccaccgtcgaaactctcgaaatagcagcaactgttttctccttcatatcagagctggaatcgagtaaccgaaccagaaccggaacgacaccctgtgcgacggctatggtgacgtttttgtcgtcttgattgagaagagataagagtgagtcgattgcggtggcgcgtgattctggtgagccgatttgcaaccgtgcgatgaggtttctcgttagagatcgaacggcttcacgtttagagaaagcgggggtttcgaggaggaggccgctacggaaaagaacatcgcagtcagtgacgtggcggtggagagtggcgatgagtgaatcgatttggctttgagtttggagtttaccgtggggtaaaatttgggattgacagtggtgagagagtgaaacggcgtcgttgagggtttggaggacggagtggaggaggtgaagggagagtgggttggtggtggaggatttggaatattcggtggagaaatcggtgaggtgggtttggagttgggttagtttgactccgaagattgaccatttggtttttaagtgatggacggtggggatttcgttttctatgagtgaattggtgaggttcagacaaatagttattgggtctgcttctgttgttgattccttcatcatgaattgaagttctatggttcaattgagaactgaaatgagctataggaagtagaaatagtgaaatagggaagaaacggttgtgtgtgggactgtgattgggattgggaggagagagagagtgaagagtgagactcgactcagcagcgttgttgacagcaatacaaagcgaagcgatgatgtggagcgtgggacacactcgcgtttgggacttgttaattcccgctagcgccacttgcctgtttcttcttaccgccaagccagccgtttgtgtctgcgctgttcaccgtgttataatcactttgttttgttgtttcaataattaagggctttcctagggtatctttaatttaaccattcatattcataatgatattatgttttatattaattcacactagacctgaaaacgacgactagagttgttcaggtgcggcggaggactacaactattcatcgatgggtgatgtatttgtaaagacttcaacgttcgagttggtgagggttaaagggacaccactttagtgccattaaggcgtcaatagcatctgccatttgaccaattaggtagtgtgtgtaaatccaaacaaaacataaacgcagaggtgcgcaggggtatacatggttgggttaacccaaaaaaaagttttggttataaatcatgtctaatttctaaaattgacataacacattctctatattgaaaatcaaaacatgttggagttacgaattatgatgttgcactttttaattattttgatgttaatgcaattttacatcatccaactttaatttgttgcaagtattttatgatgaaatttgttattaaatattataacttattattttataaatatagtgaaatagattacacaatttttttaagaaaataaaaagttgagtaatttttatgagaaaaaatacgaggattctagtcatttaatattaccaaaaaaacagaaaaataatttgggtaacccactgcccaacccaaaccaaaccgaaaactagtgggttttcccaaacccatccattaatataatgggtggacattttacctcacccaaaccggggtaccctatatggttcgggtcttgggtttggtcaaacccaacccaaacccacccacgtacacccctagaggggcgtattcctttatccttcccctttcttcacttcacttcaacccaccccaccatttcagccaccatccgccgcctcttgccgtcgttcttttcttcctcattttttttatcttattaaaaaaaaaactgaaggaattataaatgacagaaaactgttttctccctcctagcaagtcgccaccagatctcaattttgtactctgacaaacacctgtatcttgagatgccaccgatctttgctccatcctcactgtcgcacctcacttcttccatcgtcattgtaccagtatttctcatagaccccgattctcctcgccgacgtcgatctttgcattgtcggcgttgttaccgttgcactagtattgctcaatttgttctcattgtcttaaatttgttttgttttggtgggtttctactgtcaaaaaccccaatggtagtggtggtgttcctgtgattatttggtcgatggtgtgtgtatcagtgcgcgcgtggagacaaaagaggagatggaaatacagtttctttttatttgttattttctcttaaacaaaatggacacattgatctaatagctcacaagcatccaaagtcacatgactttggtgctttaaagtcactaaagcgtgatccagtttaaagagagttttagaagtttaatggaatggacaacatgcatttcacatgcatgtgcgtccttttaaatttagttgatgtgtaagggactctaagttaaaagtggttctacgtttgagagatattgtaacaccccgtttcccaaaatcaattaattaataaataaacatgcatcagagtaattcccaaacgggcatgtcacactacattttcaaattttcttaaatagaatataaaatctatttaataagcatccttcaaaatcatcattaatgttgcagcggaaatttgcatcaaaacaacaacaacagctatttaaatctccataattaaatcttggcataaaagccttatcaacataaattcaacaaccatagggctacatcagcaatattcaaaaattgatacataggaatgaaaaacaataagaaaatctcatcccgtacatatcagagccctagacactagagccaccactcctactaatcttcaaatacctgcaagttacccatacgaagggcaacatttccaagcagaaggggtgagatttctcaaacaataataataagcataaaattcatcaattacaattaacaacatagacatcatcatatacactcaataataattctccttaacatccccgtagtgctcatgaatagaagacaacttaacataaccctcatcaagtacatttaacaactcataggtaacctcatgtaatatcataacaacctcgcattcaacactatagaagatcatcataacctcgtcatactcatcaacataaacaaagtaagagtacaccacctcttatagacaacaacaaagtaagagtacaccacctcttagaaaaacgataaagtaatagtacaccacctcttataaaataacaacgtaagagtacaccacctcttataaagacgacacctaagagtacaccacctcttataaaaaacgacgtaagagtacaccacctcttataaatgacaacgtaagagtacaccacctcttatacaacaacaacgtaagagtacatcacctcttagaaaaacgataaagtaagagtacaccacctcttataaaataacaacgtaagagtacaccatctcttataaagacgacacgtaagagtacaccacctcttataaaaaaacgacgtaagagtacaccacctcttataaaacacctaaacataaacaatcaccaataacagcttcaactacgacttcaacaacttagacaacattaacaacttaagactccaatcaataccatatttcatttcaaattctgggcagagatgaaaagaaaaataagaaaaagcaacctatattatttaacttcactttcattcaaaatcatcataatcaattgattatctaaaaatctataaacaaataataaccaaattacttgaacacacaaccataaacttcattgatcaaaagcaaaacataaatttcatccaaaatatgattcgacaacatctagccaaatattattaatccctttgatataaaaattagcaccaacatgaactcattcgaacaaaagctatatcatgttttatctatataaaggcatatcattattaagctttttgaagacctttggcaaaccaaattcaccaaggtttaatcagggaacataaaaagtggaatagttgaatttaagagatcctatgacctctagaattggacaactgaatgactaattgaaccatgttgcaattaaaacaaaaaagaacaacaaaataaatcgaagcattcacaattatttattttaaaataaaaattaactttgtattctatacatgcctgatccatgctgataaaggaaaataagaaacagataggcattcaaagatcttgaccaataaaaaggcaacgatcataaaggatcaataacaaagtaataggcatagtgaataattcaaagcaattggcatccaatttacaccgatttacaataggctacgataaagcaataggcatccatatcatatatataaattaaaagagcaagtttgtctctcaaaaaccaagtacgatgacaagaatcaattacataataagaatcatacaaatcttagtattctcacggatcatgttatcaggcacgacaacaaaattggcacccactatgaataaatcatcaattcctcactttaacctaattctccaacttccttaaattaatcctactcttgttaaattaatcatcagaattacagacttaataagattgaatgctagtctcacccttaccttaattttaccttaattttgcagaaagaaatgcacagcaaaatcagttcttggctctacttgctcttctctcccttttctcccaaaaatctgttttcacgtaaactgcttctgacttctcttttcctaacttcccattacttaactccccttattttcatttaaccccccttaattctattaaatcctaattaattccccaaactccaaaataatactaatttctctattaatctaattattattaaaataaactatataataaaatataacacaccacataataatataaaatcagatgtaaaaagactttaaatcgaccaataataattaaataaaattggggcgttacagatatcatgtacagattgcatataaccattatcatacgagggtcgtaatccaatcaaaaggttcgatcccctatgttgctatacattgtacgttttggacatttcacacatattaagaaatgtaattaatattgtgtgggaaaaagatattataagttgttttacaaaattgtcatcaataaatgatatggaaagataaatgaaggaattgaaagaagagagtaataaatagttaaggatataataggaaaagtaacattaatttttcattggtattgtaaagcgacatataatttaggacaaatattttttctaaaatgacatacaatttgggacggatgaagtatttcttagccacatcgaaccttgtccattctaaaaaaaaatattgttatatatattgtgtttatgtctctctacataaaattgttcattaaatagaaaggataacaggtctcatgagtgtgctactaaaactaatgatagcacactcaacacttgtgaatgtgattaatcaatcatttgcaatagaaattcttcacataaactaacacaatgtaattaacaacaaaagaaatagaggtagagatgtttcttcttcttcttcttcttcttcttcttcactatttcaactaaaaagctaattgattcattctttaatttgatcaacaatataggcaccaattcataaaaataagacaaaaaatccttatgtgctaagtaattcataaactgcagtaatatacggatgcacttacaacatgttcatcctaatcttaacaactactaagttatacaaatataggatctcaaactttgcaactcaattgtgcacaacacatgcattccttcaattttaattggtcggtatagacttttactccgtcaatatattgaagtcaattatgatgaagaaaagggctagggatcgaaggaacaggtagaagttggaagcagtatgagcgtgacataaagacagcgaagtttcccaggtcgagtctttactcactcttctattccgaactccggaatcacatgcagtcatcctttttagtttcttttcctccttgttgttgttgctgactttcacgtgttcacacactcggtttcacaacaactctcacacgcgcacccctatgcacttcatgggtagcggctacttcacacgtttttaatggatttttttttcttcttcagggtagcggccatagaaattcatgaataagtggggtgtcctggtcgaactctgacccctgcatataaatgtataatccctttatcaaatgagttaaacgcacgaggacgattttgttactagtttaccaaaaatatttttgtcttctctaaaatataatacctatgttacttttataattttttttgatactaaacgggttaaaaaaaactccagaaaaattagaaattgcgcatgaaagaggttaaaatacgacaacgattaactaaagatagacctaatgtgattcttaaaactattacaaagacattggccaatagaatcaaaaaagtcttgcctaatattatccatgactaccagagtgttttccttcctgggagactcattaccgataattcccttatagtttttaaaacttttcattatattaaaaagcccaggaagaaagacaatggttttgtgggcattaaattggacattgcctagctatgttagctaaacaggtttggaggctacataccaaccccaattctcttattgccagatgtttcaaagcaaaatactatccccagatggacattcttcaggcccctactggaaattaccgaagctatgcttggaggagcatgcaaaactctatttggattattctcaaaggaagctgttggagaattggggatggtaattcagttagaatttggagggataactggatcccttttcatcaggatttcaaggttctatcaacagagttgcccaactcaaactacaatctagttaagggttttattctcagtgataatccctcttgggacactgaggctctccattcccaacttttacctacagactacaatcttatagaacaaatcccccttatcaacacctcaaaaaaagactctttgatgtggatgtatgaataaaatgggaattacactgtttaaagtgggtacacaactattaagagatgtcagaaccaggagtcctggtcctcccccactagtagtgctaaatctattgtctggaaaaagatatgggctctaaataccatacccagacacaagataatactgtgaagaattctccataactccttacttttcagaacggagttaaacaataggggagtccactgctccattttatgccctagatgcaactctaaaacgaagtctattactcatatttttatgcaatgctcaaaagttgccagagtgtggtttggctcgagcctcaccatcaaatttccagaacaacccaacccaaattttatagattggctctacgattttatactccacaatgatgcacatgctattattagcataacagcgatcctctataacatttggcatactcgtaatatcaaagtttttgaagacaaagacttaccagaggaagacgtaatttttcgtgcagatcgtaacattgaagaatttctgcaagctataaaatcagatgatgttgtttcaaaccccgaagttctgcaccctaatcctcgtgccgcatccactggtgtctctagctggaaaaaaccggatttgggctttcttaaagctaatagtgatgccaatttgaagaatataggcagctgaggtcttggtggcattatcaggaatgatgaaggttttagtcatgactacatcaacctggaagtctctaggtagtaatgaccatatgttagttgaaggttatgttatgctcaaaatgatggtgttagcaaaggagtgtggtctcagacaaatggtttttgagagcgatagcgagactttgattcgcatggtgaaagataaaactcagagtaatgatcttatctggaaagtattatccaggaaatctggtatatccagtcctattttgacacttgtaattttgcttttacacatagatcaggcaataaggttgcggattctttggcccatttagctcatgataaactgaatttggtttggattgaagaggtgcctttagatgcccactctttgtatttccatgacctattgaattaatataaagcacttgttatttcaaaaaaaaaaaaaaaagatagaccaaactttggttagacaagcaaccactttgcttcccggtaaatatgagtctcttcgaatggtaaaacttctaatcctaatgagtaacgagaattaagttgcaacgtgagggagacaagttatcctttcctatcgacgaatcccaattatgagtctcaaccatatacacgatcgaatttgagtatccatatttggacgatcccatcctgcatgaatatagaccatattatttattataaaaaaatgtttaaaactacattgttttatcaatttgatttttaaaaaaataaataaatagaggaaacggcttgtttaagagtttgacttaggagggtgtattaaattaagatttgaagggattttaaaagactttttaataataaaaaaatcttgtggtattcaatcaaaacttttataaaacataaataaatctcatggtattgaatcaagacaatcaagattttttattcaaggcaatcaattcccatggtattcaattgagttttgtagcaacttataaaatgtctattggtattcaaaaatcttgagattttaatagattcaattgtagagtggattttgtgagactttttagttaaaaatacacctgagatgctcattcaacaatctcacaaaaaaccttgagactttttgagacattcacaacttttgtttcatccttgtctcttaccctcacagtcatagcctctactctccttcaacgtaattattccaatttcacaccgtacactttatattattgctctcttaaaaaaaagtttttatattattgctctcttaaaaaaagtttttatattattgctctcttaaaaaaaagtttttatattattgtttctcattgttgatgtgctcattccagtcaagaaggttgttgtccacgttacatagtgatacttgtatttcaaaattgcagattcatgtgtaaatttttttaaagtcaatttattttctaatttattataattatttgaatttgtaacagaaaatttttgttgacaatgttatgttattttgttggtaaccaacaattttttcgttttttttttttgggaacaattattattattattatttgattattttgagcaacttattattattatggaaaaattgcacttttagtcccttaatttaatttcaggtaacagtttggtcctttatctttttttcatttcaatttggtccttttttgtccatttccatatacattttcaagcttcaaatctaatattcttatgcaaacatagacgagaatcatagatttgaagactcaaagaccataagaaaataaaattatgaattttaagcttaaaatttcatatgaaaatggacaaaaaggaccaaattgaaatgaaaaaaaagataaaggaccaaactgttaactgaaattaagttaagggactaaaagtgtaattttgtctattattattatcggtcaattccatattacaatttcattcactctaatattgaatttttcttaagaatcatacaatcctttcaaatcttaaaatctcatacaatcctttcaaatcttaaaagtaagttacaaatcctttcaaatcctgatttgaaaatcttgattgtaaaaagccttttaaataaagtcttttaaaatctcacaaaatcaatacaatcacacaaagtcttttaaaatctttaagattttttttgccaaaacaatctttcaaaatctcaatccaatacacctcttaaattacttttagggttgttaatctaaaatatgtaaaaagtgcaagtagatgataatttttttttagaggatattgactgggaatcacaccgtaaattgatgtctataatttgatatatatatatatgttcaccattaatgactatttatcgtgtacaaaattattacttcctccgttttaaaatgagtgtcgttttagttaaaaaattgttttaaaatgaatgtcactttcagtttctaatgcaataataactttttcttttcaattgtacccttcaattaatactatattacactactttcaaagtattattttttctttaatgaaaagcaaaccaatagttgattagaataatttggtaaaattgctatgacatttgactactttatttcattccttaatatgtgtgcaattggctaaagcgacactcattttaaaatagagggagtattttttattaatgtgtgctttttaaaaatggaaagaaaactcattagctcttgaggtattccttaataaaaaggtcttgagtacctatcaaaattcccaaagtatttggggggtgaagcactgtaactgtataataaaatcgccccttttgttcaataaaattgcaattcatcattttctgtttctatttcaaactcatttaatatgtaattaaatattattaactactactaattacaaattttgttaaaaaaaattattaattatagatatattaattataactacatcacttaaatataagctcgttttcaaaatttgtccctttttattaactaactcttttacaaatttactagatatattttattacaaaaatatccctagttatttaaaactcgagacaatcatcatcatcaatataattaagtggaaaaatgtggggtcgaagtccacaagatttcttacatgaagttttcatatcaatagctcaacatcaacattgatctcatagcatgcgagcacaaattgcataagaatattaactttttttttttttttttttttacgttaggataatatcgataaaaagtttttatcatcgttgagaggtgactaatatctgagaaaaacctgtgagacatataagacgtgttctcccctttcaactatgttttttctatacataaatcaaaactccttacaacatgcttaacgagctcaaatttcttaccacttggatggattagtccattatttacacatgattattacttatatactattaaagctaaaggctactatatcaaagatttgatgcaaacaaatttgttatataaaacatttaactactatgcatgtatacctgagatattttctttctgtacactctccttttcatatgctagtctaaacgtgaaattaagccctcaaaatatgcaatagcactaatccttgaccacctgcttaaacatagtttgatactgtatcaagaactaacacacaaaagaatgctatgaaattggatacaagaaatgtatcatggatgacttactcttgcaattcagggatatactaccatcttgttgcattcttcaaactgtaaagttcaaattattcaatttaatagagcatatacatgttccatttgaatatatatgtggttggacttcaacatcaaaacaatgtgttatatgatatttgaagagtgaaggtctagcatgtaagataagagacagtcaaaaagcctaggatacctgcctgctaataaactaaacaagggacatactcatcatcgatcagacataacatatacaaattaagtccccaattaatgtaaatggtttttagctaggcaagtcatccttggcttataaacatgactcttcatctacatacaagacccctctctcctttttacctaactactttcttcatctgatgcttaataatggtgaatgccaacttctcttatttatagcattcatcatacataatacatgtatcatataattcacgtaaaaatagcactttattggcatatgctaacatattcctcgttatcacgatttaaatgttactcattcatgatttctccttggcttggctacattatatcatatctgctgctagagaaagagataatgagttaagaatatattcttaattcttttaagaacttaattggaaggaccatcgatccattcatttacatatatcttctaggccgctttgacaatatggcaagtcaactgcatggtcctgcatgttttgatgaacccaatttaatttgcaatcgaatctgttgggtttcaaattcaccatttctcaaagtactcatcaaatcatccatcttcaatattaatatactcgatcgttatcttttgaacggttgataatctttagataattagatccatctaaatatataattacaggtcacactcacacacactcatacttcatgaagatatatgccagaacatattaatgggaaaagtaggggcaattttgagccacgaggaagtactccaatattcttgacctacgttactcggatttttagaatttgtgtttaacttaactcaatttttacaagggccgctctcatttattaacacatttttaaattttatctcatcaaatatgagattcttatcacactcttcaaatcaaagattcgacaattaaagcatgatctgagtggtccaatgtctaataactcttaatcaagtttcaattaagacccaacgcatactagaatttttatattagaccccacacatacttagcaaagtgaccctttgtcaggattagttagttagactcggtctaaattataagacaaagtactattatttgacatcaaccaatgtgaagatcgtagtcaattcctactatatgctttcttaacggggaagcttggaacaatatattcatgcatgtttctaataacatttccgtgctttgcaatccagcagttgaaaattgtgagtgaccacaattatatatgaagcaacttcacctaactggttgacttctctataaaatattatatactttttatatgaaattcttctattttgaataattgggggataaattacgacttatgaaggtcaaactcaggaattaatgcttttcatcatatatatattgggaaattttatgacataatgtgttaatttgactgattaatttatccctgttagttatatgaaatcattttttgttaaaatttggactttcaaagcattgacattttgttttaagggcaagtctattgggtgggtgtgatcgatctgtgactcataaaccccaaatctattaaaatcataatatgtctaactaacactgttttaagcaatgactcatgaaatggactatgatctatcctagaagctattctatgtgagagtgaagaagctcttataatatcttttatgcaaacaaaattataccttactaatgaaagtacaaaataccacgaaaaaagatcaacctttgatgtttaaattcgtagggtaataaaattaattattttctataaataatttttttataacaaaaataaaaataaaaattaattaaactctatcaccaatctaatctttataaatttacaaaggatatattcctcgattttttcagataaaaataagaatttgaatcattaaaaaagtaagtttggtaccacattttctttttggtaccacattttgttttggggacaatatggaactaaaagctcaaagacaaaacaacctaattacctacggccacggggaagccaagcagaatatatacaattagactatcgacccttgctctgcacgggtccttttgactaaaacatgtgcgaataagttatatcatattaaaaaaaagaatgtgaaatagtcacatgataaaaatgtattacattaatcatatcattttgacattaatatagtttgaaaaccgtacattttacatttatcatccgttatcaatttcttcaaccgtttttttttttttttttacgtattcaactcatctcttaaaataactcttgttaatagtgattgcaaataaaacaaacaaaaattgactccttcaaaacatgatccaagccttgcgccaattccttattaaatgaaccaaccttcgttaacataacttagttaatatatccggttaacattttccgatttaaattacaaatcataaattttcatttatgacatctttgtgttgcattccaatagcaaaacatgataacaatgttagaaattcttacaacttaacttgcatcacaataataagataatagttaacaatataaatcaattgctatgaaatttgctaagatagaagctgacatggtgagctagaatggaaaacaaaatagctttgtgttactcagacattaaaaaattatcacggaaataaaaagaaagattaaattcatcttagcaataaaaaaaatcatggttttttttttttgaaaccttatctttgcaatttatacaactcatattgtatcttgttttgaattctcccccacttcatttacatagacatctttgagtatatgagagataacctctagcttattagcatcctcaacaacacatagcagtgcactcaaaaaatatattcatgaaaaattgtcaattgagaaaacatcttgtttataagtcagcattatgagaaacatatttgtaaaaagaagaattacataaattgtcagaggcaaggcaggtgtagtaaatttgtaaaactcttatagctacagtcctataacttgcctatcgacgacattaaatttacaaaatactacttgtcatgatatgatatatgctctcttcatcatcttcgtcttttcctccttaatattacttaattatcaaattaccctaaaaaaattcaaatttagttaattaattcatataagtaataaatgtgttaaacgaataaaatataagtaatacaaatattaagttaggaacacttcaataattatttacatagcaattacctagacactctaagaaaaactacaacaccaattgttgcttgaattgctgtctcttgcttgttgcttgtcgagataaattcctcaagacatgacatgttaatctaggacaggacagaatgacagtgtgtaaattgcaagtgagttgagtttcaaaacattcatatatttagtttaaattttagagctgaacgccgatgcaagattaaccaatctgttctagaaacttttctctatattagaaagcataaagcatgcatggtcatttttattcatatagcgaat

SEQ ID NO: 39 - protein, 255 aa, Medicago truncatula
MAMTRESWAFVFGIIGNIISFAVFLSPLPTFYVIFKKKSAEGFQALPYVVALFSAMLWIYYAFVKRESALLLITINTFGIVVESAYIIMFLIYAPKKQRLSTIKLLLLLNVFGFGAMLLSTLYLSKGAKRLAIIGWICLVFNISVFAAPLFVISKVIRSRSVEYMPFFLSFFLTINAVMWFFYGLLLRDYYVALPNTLGFVFGIIQMVVYLIYRNATPVVEAPMKGQELSGGHIIDVVKIGTDPNRAGGGAGSKV

SEQ ID NO: 40 - protein, 262 aa, Medicago truncatula
MDVLFLTIGNVISCMTFLAPLPTFYRIYKKKSTEGFQSVPYVTALLSAMLWIYYAHVKNKATLLLLTINIYGFGIEAIYIIIFLLYASNKARLSTIKLLFLTVCGYGTMVILTTYLTKGSKRLSIIGWICMVFNICVFASPLFILKQVIKTKSVAFMPLNLSFFLTLNAIVWFFYGLLIDDFYIAIPNTLGFVFGIVQMVIYLIYKDAIPLESTKLQKPNDHVLNICEDVPNGALQPDPNQVVKSGAPAVAVIGDEDPNNGK

SEQ ID NO: 41 - DNA, 813 bp, Medicago truncatula
atggcccttttttacagcgagtattgggcttttgttttcggcgttataggcaatgtcatctcttgtatgaccttcctcgctccattaccaacattttaccgaatctacaagaagaaatctactgaagggtttcaatcagttccttatgttactgcattgttgagtgcaatgctttggatctattatgcacatgtcaaaaacaaagctacactccttctcctcacaattaacatatatggatttggaatagaggcaatttacattataatcttcctactttatgcctcaaataaagcaaggctttcgaccatcaagcttcttttcttaactgtgtgtggatatggtacgatggttattttaaccacatacctaacaaagggatccaaacgtctttctattattggatggatatgtatggtttttaacatatgtgtatttgcttctcctctctttattttgaaacaggtaataaagacgaaaagtgtagcattcatgccgctaaatttgtctttctttttgaccttaaatgctattgtgtggttcttctatggtcttcttatcgacgacttttatatcgctataccaaatacgctagggtttgttttcggtatagttcagatggtgatttatttaatttataaagatgccattccactagagtcaacgaagttacagaaaccaaatgaccatgttcttaacatttgtgaagatgtgcccaatggtgctctccaacccgacccgaatcaagtagtcaaaagtggtgctccggctgtcgcagtgatcggtgatgaggatccaaataacggaaaatga

SEQ ID NO: 42 - DNA, 158432 bp, Medicago truncatula
gaattcttctatcaactccttttcaggtccataagtcgtcgatgatccagattcatttttatatgcaacatttctaaaataacctgaatgattaaagtcctcatcgggtaagagtcctgatcccatttgaggactaggagcccctatagctattgttcccccaccccaccctccttggccggctgatttcaagttgctgaacaaagctgccggaaaatatccaagtggcttatcatcaatggtcactacccaattgttggttttgagttcctgcaaatatccatagaaacttgtaaatataccatgaattatgctctttaccaaacataaattgcttgatccaacctgaaattccaaaaatatcctgtgtgagtttactcaaggtagtgttaatttctgcgtgagttaactcgtagtgcgtgagttaaatcacacatgaacattatgagaatttcagttgaaaacgaacaaaatcagttgggtaaagagcaaaattcatgtacatatgtcccaatcgagactagattttctcaagtgattttgccatgattatatctatttaaaagtttattgcggttaacaagttaaaaaacattttgatttgatcttattttatttatttatttataacacattcttcattttattttatgttatgtataggtcatttatcttaaactatagataattttgtgcacatttttgaagataaagaatttgaactgaaaataaaaaaaaaaaaaagtgttacaaataaataagataaaaaatctttgagatcttaagagagtgtttttaatttgcataaattgtatataactgggaatagaaattgacatctcaaccataggcccaccataaacagatatgttttgtataacttcaccgacgtgatgatgatcgccagtttgaacaaaaccttgatattgcatatcgtagcatccagtcttcttgaaattatctgactgtcacaatttaatatcgtattatattttgaagaacatgtccaaaacaaaattaatctttttttgaagaagaagattcatacctaaaacaaagaatgataataaaaaaaaaagttattttactgagaacagttattttaagaaaaagtggtttctcaaaaataaattaaccatcccttaccgtccatgccaagtacaaatgtgtcttatcatcaccatatacatggggaaatacctgggaacaatttgtataataaattaatttagagtgcttttcataccaaacaatagtaaaggttcaccattgaacaatttttgagagatccttattagatgcaccttaaaattttaaagtgaatatcttgttgtaatgggataaaataaaacttacctgccatccaacatatattatattagtaccatctccctctccattttggataaatatgtgagttgaacttgcttgagcaatactacattttggattataaatgctagtagttccactgactccataataatgtagactaggatgcttaaagagagaaacttctgcaatctacaagttcaatatatgttcatgcagctgataaaatattgaaacattaattgatatttatacaaataaactaagaacataagggttgaagtcggagccagccaaagaaaaaattggataagatgtataatttttttttttaatcggcatatatattgataagccaagcacaagaagtgcaaaatggcaagctgatacaattgaaaaacaagcccctgcctactgtcaaacatgcagcagcatagggaaagtgcagaaaaaaacgcatcatacagggaggcaacaagccaaatcaccaaaaagaacaaagctatatacatgcgctccctaaaatgccaaactgcatcaacggaacctagaccaacagctgaaaggaccgaaaataccaaacctccatattcatcttctatttagacactctttaggattccaagtccactcataagagtggacgcccaaacccaagataccgctttgatatcatccacaatctcctccacatcaagattttatggagtaatgaaattaatctcaagccaatccaagacttcacgccaaattagagaggatattgttgggtcatgagggaggcctgggggaccgtccacatcgaggctagaacaaccgcacaagcaagagagacaccacactcttacccaaaacctcaaggcaatgggtttatgggtcctcttacttataaggtgttcaaccttttctattttatccgatgtgggacatataactcacacttgcacacaccaacagatacatcacaatgaaggaaaagatgtgttgacgcctccaccatcaaaccacacaacacacatacatgaggcgcatccggttccaagatgtgccgaaacgcatgtaggaactacccgtaataacgaacttggaaaatgaacccgtttatcatatcgggattcattgtttccgactctgcttcaccttaattgttattttaacaagtaaagttatgtctcggtccgagtgggaataacatgtctcttctgcatgtccatagagttttgaaaaatccaaacatcttgcctccttttgacttgaaagtgaaaatagtctaggaaacaaattaaataaaggctcttcccccaaccacctatccttccaaaaactagtattacatccattacctattttccttcttaccctagtagtgaaccaattctctccaactccatcctccaaagacattaaattccgccaccatagagaggtaaatctcggccaccttatcactccctcacccggaactagccactaacatgatcgccgtatttttccaccaacaccctctttcaaagaggttgctcctcttgaagtaagcgtcatttccacgataagatatataattaatgaaagataagtataattgacaaaacatgacattaagatataaaagtaataagtaaaaaaggaaaaaaatttgtttaaaaatgacacatgaattaagactatgcacatttgatattaagtgggttattagaatattacgggagcaaagcgagcattgttagctagaatattattattccacaaagatttagcacgaatgaggtcgtcttttgttgtccttcgaataggaacggttctagttgggcacgtgattttgtcggttggtgaaatctttgcacttgttttttctttctttattgaaaaattaggttgtctatgcaacaaatgaaagaaaaaactcaacatgaaaatggatgatacatataattaaacaaagaagattaaccaaattcaaaggtgttcaacctgtaatttatgattctttaataaaggatggtcgaaagctgcctgcttgtcaatatcaatgcaatcaactatgtatccgaattttgtctattaaaaccaccaaaatcaaacaaagagaaattataatcatcttatatagatcaaacaaaaccactaataaaatgtaggcttaattgcacttttggacccctatctttccaaaagttgcggttatggacccctaactaatttaaatacaaaacaaccccctatgttttgattctttggcagttttggacccccaaggcaaaaaaataataaaaaatttgacacgtggcacctcacgtagggtgccacgtcagcattgaccaagtcaacaatgaaatgggggtccaaaactgccaaaaaattaaaacatagggggttgttttgtatttaaattagttaggggtccataaccgcaacttttggaaagatagggatccaaaagtgcaattaaacctaaaatgtatatgtgaaaaatacatgaatactcgtaataggatccttgttaataagttttagttgtttctccaattccaactcttctttcggtgtagtttgtatgccatcaactctatggcttgtattagtcaccaaacacaaaaccaataagaacaatgtgttgatcattttcacaattttgttatcgaacacaatgaattggtgatccattacagtttagaattgtcaatttacattcaggaatcattaatagatagtgttaacttgtgcccttagaacacatgttaagaaatttaaaagaataaatattttctaaaattttgtgcattcaattcattaaaatgttaaagattaaatgtaatgtacacattctaataaattatttttatatttaacttattaacttgtatcttaagagcacaaattaacattttccttaatataatgtcatatgataattcctatttaatgtagtcaacactcaacactttagaatgaaggcctcaaaaagaaaatagtacttttgaatgaagtttagtcaaccaaaaaatatatattcgtgactagatttcctccccaaatcatcacattgcgattcaatccttatcacaaatacatgctccttacgatgcttggtgctttgatcttatcttagttattaattcatttacctttttcaaaagaaaaagttatattataaatcaaaaggtcacaattttttggggtaatttttttttctttccaaatgcgacaaatattgtgagacaaatgaatatttgataaattttttagaacaatgtgctattacatgtgattatcatactctgttaatcctatcaacaacaaaaaatcttactcttgtaacgatgttttagacgttagtttaaaatttattattgaaggagcaatcttagttgcttatattctaacaagtatcggtagaaataggccgggttgatcaacaaagcctatggccaagtctaacaaatcagaatggacttcttctcaaaatagattagactaagactttttaaaaagtttattcatctaaaaatgttatattttaggcctcaaagaaaatattttaagcctatacaaaaattatttattatattatattttgtagtttgagtcaactattttcatctttaatttaactaaaaaagtaagatagaaatatgaaaataagattatgatagataattagttagacataagtcttaattttttttattaggtctgacttagattttataaactctaactcgatttaacttattttcattcctactaataagggagacaagggtgagtaaaaaagaaaaaaaaagtcaatgtttaatgctaattcatatgcattcttttatcatattcttggttgtactgttttaaattttaatgaaatgagttattttcttttgaaaaaccttaaggtttgttaggtgaatttatgacgcataatttataagttcatatccgaaaaagatcaagctgataattgtcattttttaacaagctcatagttattttcatgagtttataacatttttgataaattaattcaaataatttatagcttatcatcttagctataaatcttttttacgagtttatacttattttcatgagtttataaaccttcgtaatagaatcggtattggtgtatgtcttcgtgatgaaggtggtgtgtttgttctggccaaaataatcaactttgttgtcgcttactcaattgatattggcgaagccttgggtctctatcacgcctagcaatgggtgagtgacatgcaactcgacaatattggttttgaaattgattccaaaagcacaagagatgcgatttactcagacaaggaagacatttatgaattaggcaatatcaccacaacttccgaagttatgctttcctccaagttcaacaactctcgggtggagtttgttaggcgacaagcaaacgtggttgctcatactctcgtagaagaggccacatttctcgctagttccgttgtttattttcatataccactttgtattgagactttgatttctttttttttttttaggaagtattgagactttgattattaatgaaatgatataaacaccattgtttaaaaaaaaaagaaaaaaaacatgaatcaaaccacttgagtaaaacgacattattccttttccctaatttctagggttttatccaagaattccctctcaaattaacaatggcattttctctgactactcaaacccaaatcatcacattgcgattcaacccttttcacagacacaaactccatacaacattagcatcaatgtcacaggcaaaatctaaaagaccaatttgcccttcatgttccaaacccacccgaacttgtctctgttctcgaattctcactcctccaatccctaattccgtcaatgtaaccattcttcaacactctcttgagtgtaatcatcctcttaattctaccagaattgctaaaatgggtctcaacaatctcactattgcaactgtttccgatgttaactttgaatctcgcttctttattcaactttttgaccccaattcaaactctgctgaaaaaggttcgttttttcgtgaatttgaggagacccatgatttgttttatgctaaagattccaactttattgatattgatactgacagtgctagtttgaaaaatgatgtcattcataattatactgttgaaaatgtgaatgatgaagttaagaaaattccgtttcgtagaagttgtgatgatctaactggaggtaatggaagacctgctattacttttactattggcaaatatggtgcaattacttctttgtcacatatttggatgaagcaatgtgaatctaatgagttattaacctttgacaagattttgtcttgtcctgaagcatgtgaagcactctcaaaagggtttttggtgaagaagtttcaaaggaagcaattgaatagggaagaagtggaagaatatgaggaatttgagcttgaggttagttctggatcggtactactttttccatcggataatgctgttagtgttggtgaattagatgttgttggttttgaggtgaagaatttgattgttctagatggaacatgggctaaggctaaaaggatttatagtgaaaatccttggttgaacattttgccgcatttgaagttggaagtgaatgagatgagcttatatggtgaagtgaggaatcagcctaaagctggttatttgtccaccattgagagtattgtgtttgctttgaaggcagttggggagaatcacaagggtttggataatctgttggatacttttgagtccatggttggtgaccaaaggcgatgtaaagatgagagactgagcaaactgttacctagttgtggtagcccttgatttcttcttttgattgaagttgaacaacttgaagaagtcgcttaaacccaaaaagaaatagttttgaaatgaattatgaaccatgaaacctctaggagtttctgccgtgcgtatcctcagcagaaggattgaaataatcaagccggaactttgaagattgcagaaacatcagcagagagatacactatcgaagcaaatccagccacgtgatgatgatgtagtaaaatgaaagattattgttaagtgttaacaacaacaaggagaaacaaattctgaaaaggaagaatatgtgaatggatttacaagctggaattcacatgacatggatatatgatattagaactcagtttttcttcacatttcttcaaaattggtatgatgccatacatgtaattgaattctcaaaacctgatttcatttgttgatagtatttcacgacagaagttttcacttaatgcttaataatcgacttatgttttacaattctattcaaagattgctggtttattaatttctattctattgttatgttattatcctcttcaatcatcagaccttcattggtcctagtagaattatcatggattttctcatttggacttttttgccgagtttgtataaaaaaaatactagtattattttgagacaagtcaacatcttattgtttatacagattgcttcacatcaataattgaagatggaatatgatgcttcctatcatataaaataagagcctcgttattaccgctattctaaaatataagatttgcttcaaaaatttccttgtcccctttttacaagacattttcaaattttcaactatttatttatgttatttaatgtttgttgtgttattattataagataggtatattatagctaatgggttctcacctcacagctagtgtagatggagtccaaactcccaattggcaagtctgctgcttcagcaccgaagtcattgactttctgatttgcaaagacagacagtcattttcatagagacagacagtcattttcattttccagttcttcggtaaatccttactcttccttaacacgtttctttctgtagttttgttgtaacataattttctttgctgtgagtgtgatgttaatgaatatgcgatcaagtgttgctcatcttctctaatttattccatttcttactggatcatgaaacatacattataattgaaggaatgattggcttcaattttatgtagaaatttattttattttagattatatctttcgcaattcttctttttttgttgcaggaaatatttgccgtagttcgttgagttttagtttgattatttttcagcttagctgcttaccgttattcaactcaatgcaaatcgaatccatcacagatcttgtggtcaaaaaagctaaacaaactaacatgtctctttcggtttggcaatatcgtgaaacatgtcgagagggaaaagaagaaattaatttcaaatcgatatcttgtgcgggaaaaagctgaagcaactgctaaaactgaaaaaatcaacaatactatttttgagtggcttaaagaaatggagaaactcatagaactgcaggagaatcttaaaacaagagcagagccagagattcccaattatgattgttcattagctggggtattttctgctgatcataggatgagatattggatgtaccatgaaatgctaggtaaaataaagacactgaatgccaagtgtgaatttgagccattttccaccacaattccagctttgaagcactttttttcactaaattgtgtgtcttttgagcctataaaagaggcttcagatagacttctagcggcactacatgataataattgttttatgattggattgtatgggaagaggggttttggtaaaacaaatttggtgaaagcagctagagatgaagattggactttgctcgaaaaacattcaggctcaggcatagaagacgagtcctcgtctgacatatcaaatgtagcacaagatgctgcttttgaatgtgaagggttacctggtacaataatagaagtgggatcttccttaaaaggtaatcctgtggaggagtggaaagaatcttcagacaatttgaggcgttcaatggctcgatggcagattttcatcagttttagaggagaagatactcggtactcttttacgggttttctctatgatgctctctgtcgagaaggattcaaaacattcatggattatgggggattgcatattggggaccaaatttcaccctctcttattaattgaagcatcaaagctttcgattgttgttttgtctgaaaattatgcaagttcctaatggtgtcttgatgagcttgcgaagatccttcagtgtaagaagtcgaagaatcaattggtttggcctatcttttacaaagtgaaaccttcagatataagacatatgagaaatagttatggcaaatatatgactgaacataaacaaaaattcggaagtgattctgagagattacagaaatggaagtcagctttttttgaagtttctggtttgtctggaaaggcttataaaatcgggtgcgtagcatactttcacatactttgattaacattatttcataattgttaatctactagttatagatgttagtttggctcttttacatgaaatattctgttcaagttctgcattttgagtgactatctgtgctatagaaaatttgttggtcatatgaaccgtgtagtttcgttagtgaaaaaaaaaattgaaatcccttgtgtatatcttgtaggtacgaatatgaatttatccgaaagattgtggaagatgccgttaatattaaacatcgactgtgtatacgaagcacagataggaactagaaggatgcctacattttctcttgcaataattaagtgctacattagatataagtgatggcaaacaactacttgttcataaatgaattatgattgtaatatacatgttcaatgataatttgtttttgaatatggtttctaggataatatttgttcgcagacgataaattagttggagaaaactctatcaaagtgttgtttttctctatcccaagactctatcaaagttttacgaaggagcaataatttccacctttttatttagaccacaaaaccatttttcctttccgaagctctattaaaacaatgtgtataattataattttaaatatccagtttttttttaaacaatggtagctaaggagttcactttgacatatgaattgtatgttgttttggtccgtatattctttctctctacgtgcaatacaaatgaagtatctgtgtatgtatggagaaatcatagtccagtgaatttctttgaagtttacagatcattgaacaatgtctttcataatcaaggtaattttgtagtctgtactctgtaatgtaggtgatgttactactgtaacatgaccctacctgtatgtatgcactgtgtaaatgcaagtcacactgctagtctttcctcaggaatggtccacttttcccaagtctaagttttccttggcttcctatgaatacaagttctgaagaataacttaagaaaatatgtatagaaattagtggagtactcgatgattcatcaaatacctccttgaaagttataacaatttcagcattagaagttttggcagaaaaattcctttctaatggttacatgttctgtgtatgccttggatctattacaggatgcatggcatctcataatttggatgtgacttttctacctgccttcaaacaattgttacataatgcatttatcaaggttctaggtgcaaaatcactaactgaacttcctctgattttgaacaacatgaagtcatatggtattgcatttgatatgttggcagagctgatcgttacaatggacagatcctctattgtgccattccatggaaatatttgactttgccttggctgctattcatattttccattaaagtcctcttttggttcaatacattgaagatttagcgggaaaaggtgtgatgaatgctatgtttgccttggctactaaaaccatttcaagtatccagaatccagagtggatgaaactacatctgcaggaagcattgatacaatgtgtagtaacatttattgcaaagagaccaccactagctttttcaatccatttacagataattaatacatgtcagtattagtatatactgcataagcagcatctatagtgagatacctcagtttactcgctcatgacagaagcctagcataatcaaactgctagttaaagaatgactacaacatacatggattacttagggtgtgtttggatggagggtttaggaggggaagggagggcttagttttcttttttaaattacagacattataaaataatttttagaaaattgaattaacaatatgataaatgatcatatagtacttcaaaaacccttaatttattttgaaaaaacattttacattggtcgtaatttaaaaaataaaaatgagttctcccctcccttctcctcctaaaccctcaatccaaacacacccttagggtgtcataagcatactcctgagctcatgtctcttctgatcaacacacattctaagcttaccaaagaggttatccaaatatcatcagcttttaccgattcatcgttatcattcctaagccaactccagaaggcatgagtaaagtttacaatcttcggcttaccacgacaaaaactggctttgcagaactcagaccactttggttgtggatttatgtacctgcaacacaacaacgatgtaagatacatattgcaggctgcacgcctactgataaataaccttgatactagtagtactttttcacacaacaaacaattcagataacggatttcaatgttgggtttggcagatattacttacctacctaagccttctctatttcaaccatcattagtcattaccaatagctatatggatagcaccacaaggatccaaccttccattatccacacgtttttgtcaatcagataaagcacgacttaagaccaaatttccattaaatctgtcgcaattttaccataaaaataagggaagtgctatatagcacgacactcaaccacacgagattccacgacatgcatgttaaaggcatggcaaaaaaagcagaagatattactaagtaaaaaaaaaaaaaaaaaaaaaaaggaaaacatgttgatgggtgatctaacggcttcaaatagtcgtgtgtgtgtcgtgcttctgaccatcgtgtcaaaaagcattttcctaaaaataataattataaattttttacataaataattaacttgaaaaaagaagaagcaagaatacactgataaacaaatattgagttaaaggacttgtgtttgcaattttgcgaagataataaaagtttggaaaagttaggtttgtggttttatctcatatcaaattacttattaatcagttcttctcgttttattttcttttctttattttttttttatgaaccaaacatagtgtaaagagggtagggaccaacttgtcccgacttttttttagagattaaggtaccgtttgccccgactttttttcagcttctctatgtttttaaggagaagttaggccaaacacaatatcaataaagtaccttcgaaaaaaagtactttttttagaatgcacaaaattaaatgaaatgagctttaaccaaaaattgttgaatgccacttcaaaaaactacttctccccaatttatttcacaagcacctctctacaactcacgcgggcaaccttttcttttattttttcaatatgtttttttcttccattttattttattttattttttgaaccgatccatttaatttttttttaatgaaggtccatttaagtttattatctattttttaaggaattttattatctttttatcacttatatattaatttcaatatcttttgattatcacaacctcgcaaatatttttattcacgttgtcaatgaatgacaccgaatgtttttattccctttcttcaacctcggaaatatatacacacacattagcgtttagagtaatactttatgtttgtctgtctgttttttttgttacgctaatgccttttaattttttttagtgttgcgtaatgcgtgtaattatttttataaaattttgattttaattaaaagtacaagtgtagttgcctaaaaaaattatacttatatatattttacacatttgtattgtaacaaactatgcatatctttttcttattaaaaaaactaaacatatattttccaatgacaccagcaatgtaacaaatataatattatataatataaattcttatctttttgactgacactaaaaatatggtattcttataacaaaatttgttatagagtataattgaaaaagaaaaaacaaattattctcattatatatacacacacatatacatattatagatgttatctctgaatatatgattgagcgtgacgaagaaaacaatataaatgaagaaatcagttcatataatccaggaagagtacaagatggaggctacatgaataaaattagaaattaaataggaattgcattgatggagagtagaaatgtttgagtttgtgatgattcatgttttttttttaaaaaagatgattattgtttttaattttcaaactactttgatattatttatgttattatttgagcctccttaaattatgtcttccattcaaatatttaacaagtcctttatatgatgatacaaatttgtattcatgttacacaaaataaacgtcattaagtaaatatagtatttgtaaaaatatatcttttatattttaaacattttttcccttcaaaaaatattttagacatttttttatttattatgttaattcataatgaattcaaagttttatttatttatagacaatgcataaatatatgcaaggtttcgggtttgaaccccatacaccactaaaaaaataataaattcaaagttttgtacactattttgccaaacagcttttaacttaaaaataactttagaactaaaaaaaaaataaaaaaaccaaacagctttaaccttttttttaaagggctttattttaaagtagtttttagacccaaaaaaaggctggccaaacggtacctaaaagttatttttattattgttaaggattaaattgagtcttgcaaattctcccaaagactaaaatatgttttcactcgaaaattaattaaattatttttgaaaaccaaaagtgaaatatttttatgcaaatgaaacaattgtaatcggacaggtgcaataatacatatttgtttttactaaaattataatttagacgaatttggtatttgaaaaataaaaagagtgaatgtttatttggatcttcacttaatttgtactacattgcatcttcagggactaaaattgttttttttttttatgaactaaattggatcttacgaattttttttggactaaaccgagttattttgaacttgagaaggctggttggttatagaataattgtagttgaagtaattaatgtaaggaaatatttgaattgatcaaatcatcctcaatttttaaaactttgacttttaagtcagctcatcatcatgtaccaagtaggaaatggaccattatgagccactttttaaccataacgtgtgttgacttgatcagatgctagtgtcaactgtcaagaggacctagttctcgtatttcctgcaattatatagatagatgggacacttgacttttctggttttgaagctaggaagagacaatcattcaaacttcaaagttcattgatacatattgttcctccctgctgcactatgtgtgagttcaaattcctttctttcatttaaattctccacctttatgtcatcgttttcacatcaaatttcctctccttttttttttattcactactggtgtgtttagttgtaagatgaaatatgtgatgatgtgagaaaaatgagagagagagtataatttgcatttgtattctctattcattactatgtactgtaaaacaatttgttttctaatttgtgtgttatttactaaagtggagcatatatgttatgattgtgggtattttttaggcaatatatgaagtcattttatattaaatatataactttttaataaattattgttatttttttcaataaaatattgttacttttagttgttttaacatgttcaatgttgaacattttagacagccctatgttgtaagttgtaacctattttatcaaactcatacctctatagatccaacattataaatataaatggaggatacgagtttatataaatccatttataaaactaacatagtattgggagagttgacaacatgactctcttttacaaaaaagaacatgagtttgattttttgagttacccatttcagaggtagccttggtaaaaaaagaaaaaatcagttgatccacggttgacttgagaattagtcccgtcgggttcgggatacttggggcgtctaatggagattctataattatgatcaattagaaaagataattctatttgtgtaggattttttttagatgatttacaggaacttcattttttatatatatgccattgaaatttagattggttatttttcagattaccttgccattggacttgctacatacaagataaccataactgttgtttgtatcatatcgattattctgataaagacgatcaataaactatgtgtatatcgagcttacaaaatcattaaagatgtagaaagagaaaagaaaaagctaatatcaaatcatgattcagtacaagaaaaaattgaagcaaccgatcataaaactcaaaaggtcaatgatattgttcttgagtggctaaaagaagtggaaaaacttgtacaagaggtggagaatgtgacaataataccagaaccagaatcaagatatcccaataaaatgcttaacaaattaaaggcattgaatatcaaatgtgagtttgagccatttttcaatccaattccaagtttagagcacttctcttctggaaattttgtatgttttgagcctataaaagagacttcagatagacttttggaggcactagaaaatcgtaagttctataaaattggattgtatggaaagcgaggctctggtaaaacaaagttggttaaagcagtggctgagaaagccaggtacctgagggtttttgctgcagttttatttatcactgtgtctcaaaatccaaatgtaaaacagattcaagatgaaatagctgactttttggatctcaaatttgacaaaaacactgaagttggaagagctagagaattatacttgacattagaaagcacagatcgtccaattcttgtgatcttggatgatgtttgggaaaatcttgatcttgaggaattaggcattccttgtaatagtaatcgatgcaaggttcttttgacgacgcattgcaaacaagaattcgcactaatgaactgccaagaagagattccattgtgtcccttatctatagaggaagcttggactttgtttaagaagcattcagggatagacgatgagtcctcaactgatctattaaatgtggcatacgaagttgcaattgaatgtcaagggttgcctggaacaattaaagatgtgggatcatccttaagaagtaaacctattgaggagtggaaaacatcattagacggtctaagacattctatgtctcagtacgatattttcatcagttttagaggaaaagatactcgtgactcttttacgggttttctctatgatgctctatgccgggaagggttcaagaccttcatggatgatgaggggttgaagggtggagacgaaatttcatcttctctaatcaaagcaattgaggcatcaaggatttcagttattgttttctctaaaaaaattgcacattcttcttggtgtctagatgaattggtcactattcttaagtgtaaaaagatgaagaaccaacagattttgccgattttttataaaatagaaccgtccgatgtaaggcatcagaaaaacagttatgaaagaggaatggctaaacaagtaaaaaggtttggtaatgactttgagaagttacagatatggaggtcagctttacttgaagttgctagcttgagtggaataacttacaaaactgggtacgtggtatgctttcaaatatttttagtttcatagttgatgcctggtctactagtactactgctctggtaactaataatatgattgaataacttagtacgtggtattcttttaattgaataaaatcgatgaaaacttcgtatgtacatgaattaatgtctttaattttgcaggtacgaatataaactagtccaaacgatcgtggaaagagtaaagagccaaatttaatggtgtcaaatttaatcttcaaatatcacttttttttctttccaatctagtctttaaagtgtatgaaaattataaacattccttgaattatacgaagctgtaatgtgcatgttgttaagacagtggtatgaagttgttttcaacaggttcgatgttccttgaagttttgactgcacctatattctgtgtcaatgaaaactaagataaacacaataattatattgtcatatgaaacttgaacaaaaaaggatcctgttttttatagacatttattagttcataaatgtgtaagttgttaacttttttaacatgttccttaaaaaaaatgtatttgttatttaaactacttggcagaaagtatgagtttagtccatcctaatgtacaaatatgaaaccttctgacggaactacatgttatggaactatgtctgcattcatcaagacacataaattcttttgaaaatgtttggtaacaaataagatttcaacacataatttatcacaaacttctaatttaaatcattgtaatggtgtatttggcttttttatagcaaaaatatcagtatcgatatgacggttgcaaacttgcaataaatgtagtatattctgatccattcttactatcagaaccactagagaatccctcaccgcgattttgaaattcccttcgatcagaagcattcacaaaagcacttgattcatcgagagagacatgggaagtgatcactctgtttttgttatcttcttgaggaagaggattaatgagcaaaccctgagttttaactacataaaatttctcattcaaaccagttaagaattgaataacctgatctttggtgtgataattgcatgcaacatgcataacttcacaattctgtgaaatttagctcctcccacagagatttagtatttgtgaaataatccaaaacatattttgatcattgcttaagatttttaattccataacataaatatgataagtgaatcctaacaactttagagaacctttctttgagatcctccaacacaacaacattttcatggaaacctatggtttgtgctatagattcagaaacaaaattgatgaaccatgaatgaataagatgattacatcgttctcatgcacctcaattcaaatcaaatagatcataaacaggagtggttccctcaatgaatgcaagcttgtcttagctcctaacatttgttgcattgatctgctccttgcaagataatttgatccattaaaacgaaaacaaaatttggtcattcgtttgaataaatgtagaaaatggaattggtatcaatttcttgattatgaacatgaagcggtatttggcacggaggaatgatgatgatgatgaatgttgaagcaagatatggaagagaaatcaatcacaaagaacagagaaattgaagcaattcaaccacaaaatctatgataattgatgaaaaatgagagaatcttgacaagaatcaagatcaaagaagcaaaacgtaatgaaaattgatgaagatcaacgagaatgatgaacgataagtgaacttgaaaaacagttatggatcgtaactctctctctctctctgaagaagagggaaaatatgatatcataatagtagtaagccacatgataactatggtgaggcatcaaccatagaatgcaaagaacaaagtaacttgataacttgttacacaagttatctctataaactaagctaagtaggtgcattctcctcatggtggaatgaagttataatcttgctctccatgtcttgaatcttatcataaattataatcttgttgataaagctaatagtgtggtttttaagcaacgttgtgggatgactctaagtgggtcgaagcctccatctaatggatgggtcaagttaaacgctgatggtacttgtagagataatggtatagctagttatggtgacatcgttcagaggagtgatggcgtgtggttgggcagatttgctaaacgcattggaaagtgtagtgcgtatatggtagagctctgggagcgtataaagggtttagttatgctagaaacttggggtttcgagttgtagaggtcaacatggattcattattagtggcttctttgggagcttctatgatgaagtcgggtaaatgacttcttcggtgaagtcgtttgaatggaccaatcagatttcaagccatgacacgtcagatgttaggacaaattacaatatggatcacttgcttcatatgttccaccgtggacaagtttatttcaagatcttaacggttaggtttacttggtgtctatgttattgtggtacaccctttacacatgatttttcttataattccaaatctctctcctctttatcactcatgcatctctcatatttctttgtctttctttatttatacatattatctcccttccatatttttattaaatcaccatgtcactcttcaacatcttcatcatacattcatcatcttcatcttcttcgtatgaaaaaaaaatccaaaaagaaagaaattacataattaaaaaaaaatatatatattacttcaatggttatttatcttatttaattgtaatagattgatcttttatctttatttttgttctcatattggtcctttatctttataatcttgcacaagttggtcctttttttcattttctattaaaatttgataatgtggcaaaccacatagtataattttgctatttttttatattgaaaatcataaaactctaaaatcacatgattattcatcttcttcgtctgatcttcatgatctcctttcttaaacaaaaaaataaattcaccaaaatccacctcaaaattacatgaatttatgtgtattgtttatttacatcttcttctaaactctaaaattaaaatcccaaaaaaaatttaacccccttttgatacgttttccatctttctattctacgggattaaaatcccaattcacaaatttctaaaaaaacggcagcctgcatataacttcattttcatagtacattatttcaataaataacctagatctcgattttaattggtgaccaattgtaatttgtataccgtcgaagcttgaggaatatattcttcaatgattaaataatcaatttctcacctgaaagtgtaaatttcatcaattatctccctgaaattaacaaaacttcaattaccccctgaaatttcacaacgttggtcaatttaccccatccgtcaaatttttctgttagtgaacatgacgttttgcaaataccccctgaagttttgcacttatgtgcaaaatgccccctaaacttaaaaatttatattatttttttcttcaaaacaaacaattaatagttaaatattaaaactaactattaattttggaatttggaaaaactacatgcatatatacatcaaaataggctccaaaatggggaaaaatatgtattttttaaagtgacaataatgggatgatttgtggattaatattggaggttgtgtagtttaaatggtttgagcaaattgttgaaagagttggaggagttgaaagactaagatggtgaaggagaaaatataaatttaaatctgattattaatttgtttataaacctctaaaaataataatttgtctattataaataaccattattgtcactttaaaaatacacatttttctctattttgatgtatatatgtatgtagtttttccaaactccaaaattaatagttagttttaatatttaattattaattgtttgtttttaagaaataaataatataaatttttaagtttggggggcattttgcacataagtgcaaaatttcagggggtatttgcaaaatgtcatgttcgctaacagaaaaatttgacggaggggcaaattgactaacgttgtgaaatttcatggggtaattgaagttttgttaatttcagagaggtaattgatgaaacttacaatttcaagaaaaaaattgactatttactcattcttcaaaatatcctgtaatttttgctgaagcgaacaaaagaaagaaagctaattatgatggacgattctagatgtaagtgatgtttttgaatgtgaaactgagatattgtttttctaaattgaaagatcatgaagatgatgagtttaacatgagtccagatcgatcacgttaattaaaaaaaaaggatgctgaagatcttgattttgaaattaatatttaatcgtgggtttaagtttttttttggtttttttttattatttcttgtctattatttccgccaatcattttctttttttccctgagaacactatagtcattttctttttttattattttcttttttctgtcaaagctatgtatatactactataatctactccctccgtccctcaatagatgacttagttgacttcgacacatgtaccaatgcatatgttttatctttgatatcttcaattctctacaaaaaaaaaattatgaaaatttaatattttaaaaatattcatcgagacgaatccaacaacatcttacatgatattatttatctttatgaattagtagaaaaatatggtcaaattacgttaagtcaataatatatattgtcaaatacgtcatttatttagagacggatagagtatataattactctctactcaccatccatttatgctgccgctgatcatctgttgcaggtatattaattttatattataatttttaattagagctagaaatcatatagccaaaaaaaaatcaacaacaaaaattgcaggtaaattaatactactccctccgtcccttaatacttgatccatttggaattttttaattttgacctaactgattttgaccgtatttttcaactaatatacaaagataaatagcatcatataagatgtcgttagattcgtctcgatgagtattttcaaaatatcaaattttcataatttttcctaatatattattcaagatatttaagctcaaagttatgcattgacatgcgtaataaagtcaactgggtcaagtattaagggacggagggagtagtaactaaagaatattccaccataatactccctccgtcccgcaataaatgacctgtttgaaaatgtgcaattttgacctaatttacttcgaccatatttttctactaatatacaaagataaataatatcatataagatgtcgttagattcgtctcgatgaatattttcaaaatatcaaatttttataatttttttaatatattattcaagatatttaaactcaaaattacgcattggtatgcgtaattgggtcaactgtgtcacttattaaaggaaggagggagtagtattacttatgcagttagctcaatccctttcaaattcctttcttggtaacgcaaagtcttctttttcatctagtcattagtgctctttcttatcaattcaattaagtcataagtgctctttaaattcctttcttggtaaatcaaagtcttctttttcatctagatattaagtcataagtgctctttaattcgtttcaaaatttgtttttagtaaaaaaaaaccaaaatatctttgcataagtttcctttttcgtttttgttatttatttatttttaaaatagaccttgatgctttattgttgcctaatagaatagttaacttggatgaaattcaataaataaataataatgaaaaaaataattaaatacttcattgatatttaaagtgacaattattgtgagatgaatggagtatcattttcccctaactgtccttcttaattcccactaaatcacaaatttgatggactaaaccatcatgttacacaaatgaccgccttaacgttaattatcaacactttgtaaaaaaataataattcatgatcatcacttattattttcgtttctcaataccgtatcgcatatgccaatgtatattttctttttcccacgaaacattttgttttccaaggcagctactatatgtgacgccattttcataactaaattcatttgagattattaaaagaagttttacaaatggctccataattttaatggttcacgtggtaaattttttataatagccgacaaatccattgtcatatacacatgcatataatcttaattttaactaagcgtcagtcgcttttgttaataaagaatgatttttaaagaaacaaagaatgataaattggtaaaataataatgcggtgaaaggtaaaattgaatgaaaaatgttaaaccgaaacataattattttttatataaaggcaaaataaggtttttttagagaacttaatattctatcgttatgaattgtttctcatattgttgtgattatttcctttttaatggaaaaatatttcttcttaaaaaaataaaataatttcttatgcaaatataagcacattaaatttgcaacaagtgcaatgcaaatattaaacggtgttttacgtataaaatttaaaaatattgaatagaagcattgtattaatgttgatatttttaaaaagtgagtggctatttgacaaaacaaattactaatgatcacattttaaaaagtaattatgagtttttaaaattttatcatatcgatatttgaaatctgcaacgggtgcggtgcaaatgttttccatataaaataaaaaatatttaataagaacacttattagtgttgatattttaaaatagttatgagttttcaaaattctatcatatcgactttctaatatcggtacataaaaattttgttctttcaaaaaataaatatatttcttctgcagatatttttaaaatagtgatcaaactattaaagttttataaacgatgcaatagctagcgtgaatgaaatagaaacaataattgaaattagaaacgtgaatgagtaatatcaatggcggcgcaaatgcaaagaataaagagacaattgaaactttgaattaaactaaaagtagtttgcagaacctcaactatcaatttattgaagttgttgttccttttttttttttgaaaggaagttgttcctaatttaattttttttttagtagatagacgaaatggcaaagccattataaactcacacacacaagtggaggtatcggggttcgaaccccggtcatggtatccggcctaacaatttcggcatttttgccagttgagctatgacttctggatcctaatttaattatttagaagttgagttttgatttttgtgtttagaagaagatttgtggtgaacataacaaaaaatcatgatatttggacatatatttgtgtagaaatttttttgattcaaggaaatgatgaagatccgaaagaagaatatgaagattgaaaggaagaagataaaaatgatgaacatgttcatcttatttctggattttttttatttttaataaaaatatactttaaaaaataaaattatgtattttttttaaaaacaaatgagaaaaaggacttagcaaaagaagtatgtgcttttttcttgaatttcaattccgatcataataacacttaaaatcaaaatggacacgatgcaaataattaactatgttttgcatataaaataataatatttacaatgggtgttgtgtaaattaattttcaaaattttatcatatcaactattgtctaaaaaaaacatatcgacttattggaataagaacgctatcaaatataatcaatcggaccattgaatatgaccttattggaataagaacaaggtaggaactgaaatttttgaaatcagaatcttcgatgtaagttgatctgacgaactattccattataaacatagtcacattggaaggacgacattgttctgacaatcaaaacggacacaaccgaccaactctatcaaatataataaatcggaccattgaatatgtccttaatggaataagaacgaatcatgaactgaattttcaaaaatcagaatcttcgatgtaagtcaatctgatgaactatcacattagaaacatagttagtcaacatataaacagttgtagtaaagttttttttgactacgtgcatataaacatataaattctgcaatatgtagtgtaaatatttaacggtgttttgcatacaaataaaaaatatatataattcaacaaaaaaatatttttttgaatacttgcatattatgttaatattatatttaataatgatgttttgaaggaaaaaaaaaaatgtagatataacatacttacatatataatatatttcgattctaaacataaaaagatagataacacaatagttacaatttcaatgttgcgcaacgttgtacatggttcgattcatgttgtctttagttttttcaaatttgaaatttctctacgaagatcttaaagtcaaagcttgagcaattaccaaaattaattttttcacactttttattcctttttttttttttttttcttttcaatttttttttttttaacttcatcttcaacctttatatgggtcagttcgacccggttgaagacccacataacccaaaacatgaaaccatgaactagaagttaaccaaggttaattgagaagcaatttaatgaatttgatgctccaaaaaagtagaatcaccgacaacaatcagtgactgttgcatctacaaaataccctttgctattcacacactcaaacaacacccatacaccccattggtcctttcagccacagttatcaccgccatctccaaaacatggaatatcacaaagttactcaacatttctccaacgaaccgagacaactctacccaccttcgttcactacatagattctatattatctaatttcaatcgttcttgttccgaaaccctaattatgatgattggtcatttaatctaactgtatctagttttataattgagtttatctgaagattctgttatgataattgaaaattatgggtttctcttcaaaccattgttagcatctaaattacttgaactatttgtggttaattgagttttagggattttgagattataagaagatcaaagtagagatgtttaatttagatgtgtatttaagtgtacttttttttaatcaaggaggaagatgatgaagatattcatatgacttatgaatttctttatctttttaattaaaaatattttaacaaataaggttattaataaaactattatttcagcatcctttcaacaaaaaaaaaaaaactattatttcagcatttttataataaaaaaaatgaaaaaaggacttatgtgttacaaaaacatagtctatatcaagagataataggaaaaataattcattatagttttgataatcaaatatgaaaatttataatttgatacaaactaatcataatttgagatatataataagattgttttgatggttgaaactaatgatttaagatatatatcaaaattgctatgaaaaaaatatgcaatgaccaaaaacaaatttaaacgttattaaataatagtaatgaatttaaactttattaaaataatgaattttcaatttaaacaaaattttaatacaaaggatttatgacaggatttatagtgtaattttgccataaataaataaataaattggaataaatatgttgttgaaatagaagtaagaaaaagtcaaacaggagaaagggaataaatatagtgtgaaaggcaacacgataacattagtgatgtgtttaatctgatggttcaaaaaagttagtctacggtggaacatattgagcaggtacacggtacataccattccacaatttgcacacatgacatgtggcgcattattattggatgtaggataacttcatcgaaaaagtcaattgaacaacttcaccatagaatttcccatgttcttaatagtacgtaacaatgatgatagtcatatggataaagccttggttgcgaaaattcagattcttttagcaatggattgagaagttgttgtgaggaattcttataggaaagcatatcaatgcgcaaatatgttagccaacttgaaattttttcctattctccataatattttatattgagtgacaaaatttagactcaaattacatatttcatacttaaatttaatttcaggtaatactttcattatatatatatatatatatatatatatatatatatatatatatatatcttcttcttttttcaaatttaatccttgacttgcattaaataaaatgaacagtataatggtgtcacacactgtcactagtgtccaaaggcaaaggttggtagagccattgctttctgctttgactgattcttactgcgtgttggcatatttgcgcgttgacatactactgctttgttggcaacttggcatatttacgtgttgacatatatatattccttcctacaaatttctacaagtatatatatatatatatatatatatatatattcttctttttccctacatagtttgacatccctaagcaaattcaatcacattaattgataggatatagttgcagttgaattggattggaaatctcagcattctgcttgctctccgtcttcaagtgagttaaaattccattcacttatttttttttcatatgttttttaaattcgcatatttagcatgtaaaagtaaaaaaaaaaaaaaaatcctcactacagttgaaagagatagtttacctgtcaaaattgaattcaattaaaacccatggtttccataactccattaatggtttctataatttcatttgattgagataacaaacgaactaggggatcaaattgaaaaaccatgattaatacttttctgatttttcaagcgaaaagataaattgaaacaaaacttgtagcaccatatttttttgttatggggtattaagtattaactagcaataccatgaagaggtaaatactttcgacgaagtggaaaatgaaaactagattattgttctttcatcaatttagttcctacatacttataatattttattccatatcacggttattgaatgggttgatgttgcaatgtgcatatatgagtattcaatagtctccctattcttatataggtgccatttaacttggatccatgaagttttggtctaagatggactaatttttttttaacctttagattgaatcaactatcaattcttatcatggtctatccacactaaatacaacccatcaattacataataaaatataaatgacataaatagacattcgtaattcgtaattcataataaaatgtaaatcaattaatatttaagatttttaataatttaaattaatcaatttaatatatattttacatattaataaattaatattttaatttttttggtcaaaatacttaattaattttttaattaaattatattttcaatttaattcatttcaattttttatttcagtttcaattaaataaattattttcagttttaagttttattttacgtgtatcagatttttgtcattaatatttaagtatagaattttattttaaaaccaaaacaaaaaataatgaacccataagattaaaaacaaaaatattaatgaaagaactagtccagtgagattaattatcttgatacttgtattgctaaatggaaagaaagaaaaattgataaaaaaaaggaaaaggagagagagaaaatgagagttatagagtagatgtgtaagatttgatgtttatagaccatgataagatttggtgagttcatataatctaatggtacaaaaaattggtccatcatagaccaatatttttataatattttattccatatcacggttattgaatgggttgatgttgcaatgtgcatatatgagtattcaatagtctccccattcctaaatattgggtgtttaactttttttgttgtgtcaaaaaacactttttttttcctcaaaattttggatattttatttgtatatctcatatttgatgatatttttaagggttatgttaaacgatgcctccggaacattggttattgacttttaagggattgataacacaatttccaacgcagtgcatgttatatttgctcttaaccagtgtcctgagaacaccggttaacatttcccaatttttaaacatgaataaagcatgagaaatgttaacaaatgcccttatggcacttgataataggtttaaaatggaaactttatcttgaaacttgtgtattgaacacattaaaacatcaaaaagtaactttttttttgcataaaaattatcaattgttttcattttttaaattcttaactaatccccttagaacacttgttaacaagacccataaaatattaatagtttttttctaaaaagttcatgtggatttagcttggttgacaaagtcattccataatatatgtatgggtcaacattttaatccagacacatcaattatttaccttatgaaaatgtttagtcattaagctagagcaaaatattaataatttttaacaacttatgctctcaatttatatattaagtcatctaacttttctaattaatatctatctgctatttttttcttaattgcagttttggtccctctatttttatcattttataaaattggccttcaattttaaaattcgatagttttgatccctctatcatattttttaactaaataaaagtgatgtgatagattttaaatgtcgtgatatatgatcggaagacgagaaaatatcaacatcgatgaaatcataagaaaattctcttgaaaacaccatttaaaacttgttatatcatcatattttagacaaaaatttagatagaatgatcaaaactgtcgaattttaaaatagggagactaattttacaaaaaaagatgaaaataggaggaccaaaactgcaattaaccttcttttttttgcgcaactttctactattctattcaatgtgtaaattaaactaatgggttcacactttacactagcttgccttgattgcaattagtactcagcctccaaacgacggttattcaaagttcacggatacatcgtttctgcctgctgcagctgcaacttaaattgtactactactattctattctatgggtaaattctcttctttatttcacttcaaatttcttccttttattcattcactactactgctgccagtcttgtgcaaattttgttaatacatgcaagatattaatgatttttttttaagttaatatcctagctatatacaaaagatacatagttttggtgtagtaatttttctttcaatatgtcccttatataaattatgttttctttttccaattcctaactattttttaatttttcaattatgtcccttatcaaacaaaacaattatttgtctatctgatcttaactcagttggtaaggaaggacaatgcataattgctacttgcttatattatatgagactcaaaccccagacaccaccaaaaaagcaaaacaattatcactgaaggcatagctaaattccatttatatagtaatttatctttattaaatctaccactgaaatttatattgattattttcagattatcttcccactggatttattactacttacaaacaatccataattgctacttgcttagtcggaacttgtattctggtaagccaaatcgacgaacgacgtgacaatcgggctcgcaaaacaataaaaaatgtggaaagcgaaaagatgaaggtgatttcaaaccgagatcatgttaagaaaaaaattgaagcaactgatcgtttaaccgaaagggtgaatgatgatgtgtttgagtggctaagagaaacagaaatagttttacaagaggtggggaatatgacagtagtggatgaacttgggcaattgtcaagacaagaaaaacataggcaattgacgaatgatggtgcagtgaaacatcgccataaaatgctagacaaattaaaggcattgaatatccgatgtgaattcaagctattttccagtcctattccaagtttagaacacttctcttctgaaaattttgtgtgtttcgcgtctaccaaagaggcttcagatagacttttgcaggcactgcaaagtgataattcatataaaattggattgtatgggaaacgcggctctggtaaaacaacattagtgaaagcagtggctgagaaagccaagtactccaagttttttgatgaagttttatttatcaatgtgtcccaaaacccaaacataaaaaggattcaagatgaaattgctaacgagttgaatctggaattcgacgtaaatactgaagctggaagaacaagaaaaatatacttgacattagcaaatatggatcgccaaattcttgtgatcttggatgatgtttcggaaaatcttgatccagaaaaggtaggcattccttgtaatagtaatcgatgcaaggtccttttgaccacatgtcgccaacaagattgtgagtttatacattgtcaaagggagattcaacttagtcctttatccacagaggaagcttggactttgttcaaaaaacattcagggatagataatgagtcttcatccgacctgaaaaatgtggcatacaatgttgctattgaatgtgaagggttacctagaacaattatagacgcgggatcttccttaagaagcaaacctatcgaggagtggaaagcatcgttagaccatctgaaatattcaaggtctcaatatgatatttttctaagttttaaaggagaagatactcgctactctttcacaggttttctctataatattctgtgtcgagaggggttcaagaccttcatggatgatgaggaattgaagggtgggaatgaaatttcatcatctctaatcaaagcaattgaggcatcaaggatttcaattgttgttttctctgaaaactttgcagattctccctggtgtctagatgaattggtcactatgctaaagtgcaaggagaggaagaaccaacagattttgccaatcttttacaaaatagaaccatcttgggtaagacatcagagaaatagttatggaaaagccatgactaagcatgaagaagagtttggaaatgactctgaaaaggtgaataaatggaggtcagctttatgtgaagttgctaacttgagtggagaacatcacaaatatgggtatgtatgtggcatgcttttaaatatttttagttgcacaattcatgtttactcctttttatgaaaaatattatcatttaatatttactcatctgtcctaatttaaattcaaaacctccaacttcttttaacttttagttcaaatctgctgtggatttttttgtgaggtaatgattgtttagtacctcattttttaaggtcaatgaaattatgaacaggaatcctttaaaggttgactttctttttgtcaaataacatccgcacattttaaacgtagtagttaagagtttggatttcgaatttcaactcttgtataattttgtctttgcagctatcaatattaactgagctgtcttatgtgcgatttgttaaaatgttgttataccatgagaaattgtatattgtgaaagttttattttcagttcaagtgcaaatttcaattttgtgaaggttaattttaattttatatattcttttaaccgaatgaactttgattaatagataatatgaaaactttgtgcaatacatgaattaacaagtctttgattttgcaggtacgaatataaactagtccaaaagatcgtggaaagaatacgaagccaaacttaatcgtgtcaaattcaatcttcaagtatctcactccttcttctatctaatccttaaaatgtaaggaaatgataaatattccatgaatcatgtgaagttgtaagtgttataagttgttttcaacacgtttcatgttccttgatcgataattagtttaagattttcggtgattttgttttctgaaattgtatagtaccgtctttttataaatatatatgcacaagttttgatatgactgcatctaatgaagaataagataaacacaataaatatattttgtataacacggtcatatgaaactttatcaaaacatgatccgtgtttttttaggggctaaattattaagaaagattgaaaatgagaaatgattcattagattgtgaatgtgttacatcaaggtatatatacaatatgaaaatgtactatcaaatatgaagtgtactacatgtaggttagtttcttgtactgcattctcatgcttcttattagttgaatcttcattgtgtaatataaattctttaaattagatgtttataataagttaactttataagattttattttgtaatgacttactcattttagttcataaaagtgtaagttgttaaaacacaaacatgaaacctactctatgtgtttacttcaccgtgatgtaaaaacatgaaatcttatgactgatctatatgtcctaacacctagggctgagcattagaatcggacccgcccgaaacccgtccaaactgccacatgttttaattaaacgggcggatcgggtcggttgtcggatttggaaactgaaaaaactcgagtatatacgaggtccaatggtcggttgcggttcttgaaattaaaaaccatcggtagttgtaaccgaccgagtagtaggcacacaatctcaaaagtcttgtacacacaaaccaaccaaccacggtcactgagacactaatttaatatttgtgtttaaatactcacaagacatgagaggtctccataaaagacagtgcacgtgacttgtgaaagtagaaggataataataagggaaattctaacttgtacctaggcacaagttaaaaaactaaaaatagaattattctcatggaacttgttagtttaatgttgtaaaaatttaataatttatattttcaatacaaaatttttttttttttttccttaacttatgtccttagagtacaagttagtaagaccctaataataaatattactgctataattttttattatggtcattattatccaaaactaagtaacaaaccaaagatctttcaatctccagtaaaaaaagaaacatgcttatcttctccaaagtcacgactaataaaaccaccacgtctccattgccacctacacagagagaatcactctactacatgacttgggtcctcgctcgtcgtcactctagttggcttggcgggaatcactttaattgagaaccaaagagttgctttagatcatacctattttcactttctgtttttttttcctttgatgcaatccatccacctctcttgttcaatgcttcttcggtgtctctcggtatttttttcattgttcaggttcatagacgacccaacccacccgtggaacccgtccaaccaaagaacccgaacccgagcaaaccgagtacatgagtggtcaaatttgggtcttaagattgaatgatcggtttcatctggtatgcctctttcgggcctgaatccatccgatgctctaccctactaaaacccactatacgtaaacacaaattctttacaattttggtaacaaacaagacatcaatacatattttcttcatgtaaaccgaccatagttcttgatggataaaaaagtaggatgagctacacactatatatgttctagtcacaaagagcaaataacaagcacatcaactgttttgtaacataatttgtttaaacggttaataacttacacttttacaaattatatggactaactcgttaaaaaattaaagaactaatttgttgcaatgatttagcttaaattttctaatatttggtttttctatatatgaaaaaaagaaatcagttttgattcgactctatgaatgcaaatagctaattattttgacctcccctttctatccaatttagacttcttgtagaaaaagagaagtcgactcacaattgaaattttactgagagcatgttcgagtgtccagaattcagagtgggtgagactggatctgcatgaagcattgataattttttttttttagggaaatcttaacgcgtgtttcatattaagtttttgcgaaaatatatgtaatttttttgtcctcgtgagtttagtttagttggttggaaagtttttaatataacgtatgaatctatttgatagatagagaaataatttagggactaatttgatcgaaatattattacagaaaggtgacatttctaaatcatcttcatcctcttttcattagaactttacacacgcctagaacaatacaataccatgttaaaaatctcaaacaagcaaatttgatggccttcctgggttttttgaagtattggattttttaacaacacaaattctaggacaccaacattcaagcactctcacatcaccattaaacttggaaattgaagatgaagctcgactttcataactattttttcccatatttccaccccccatcatttcagaatcaatttcaatagttttgcttcaagaaattttcaagattttggctttcatattcaatacggaaaaaattagggtttcaagtttgttgaattggggaagagctggaccacttattattggaggaaatttttgtgattttggagtgtagattgcatattgtgtaattagggttccaattttatacaataggagaagaaagagtcgtaggggaataaaagatctgtttgggaagaaagccaaagcattttctgcaaatcaatcaatttagtcctttgaaatgttttttattatcggccaaattagtctctgcctacgtggcgtctgacatgtgagaggttgacggccacgtcagcaccgttaacgctccgtttgaacagaaggactaacttgattcacatttaacaaattcagggattaaattgatatttcgcataattgagggacgattttggccgacccgtgaaaattcagggacgaagttgatgattcactcaaaagaaaaagttataattgcacccatttgaggttggcttagtggttagcttgagatcttggagtttgctcctctcaaggtctcaagttcaattctctatggtgctaatttcgttgggcaagtcctttaaatggggtcccctcaagtggacagcgagattgatcctttcggattagtcggtccttgaaatcggataccgagttttaaaaaaagaagttattattgctttggaaaatgaaagtgatgttcaatttgaaccaattgttttggctaaaacgacactcattttgaaacgggaggagtatgcgttattaggggtgttcaaaaccgaatcaacccaatagaaataccgcaaaccgaaccaacacaaaccgaaaccgcgaaaaaccgtatttaattcggatgtatttggatcatttttttactcaactgtatagtttaattcggtttgtggtttttattttaccaacagaatcaaactaaaccaaaccgctacataaaaaaacactaattaaacatatgtcacttagaccatactcagaaactcactgaatttttttttaaaatgacatatttttttctcctgttaagtttcttcattgttttttattgtaaaaatgtatttatgtgctacttgaacttttagagaatgataaaatcttagtcttttgcatttcttaaaaaataagattattttttatccacattttttatttggtcatgttgttagaaatattattggatgaaaatgaaattataacattggaaggaatttaaaacattgttggaaacattgccaaaaaattgtcgtgctttagctttctaacttgattttgatgttgaaaataaaaattgtattgtctaaaaaaaccgtatcaattaatccagcttaaactgcaatgatttggttcggattttattttaaaagtcaaccgaaccaaaccaaaccacgtgttttttcatcttgcagttcagattactttaaatctcaaaatcgaactaaaccgcaccaaaaatacccctatgagttatgattcaattgctaaaaatgttttttttataactactaacaatatgtctttgttaactctcatttattgattctcaaatttaaatagcaacctttttactactcagcatgtttaagtatttatccttcacaaaaaaagtagctcaatggctagaatataacctattaagatgaataagtatgaaatttagggttcgaacatcagcctctgtatatataatgcaatgtttatatcaactgagttatgttcaagagtattaatatcttaaataatctgataaaaaaaattcaatttttatttttatggttaaaagtagaaagacacaagcacgttagtaaatatcttgatgttagtttgaataataaaaatggaaaattatatgcagttaacacatctgaatcgttcgattatgatcgaacgattaagatttaagctcagaatttgtttgtgtttaaatctgaaatttgattttaaaattgagaatatccgtccaatcttgatcgaacgatttagatgtactagctagcaacaacgtattcacatgctcccagctaaacagtaaacacgacaaactcaaaccgacaactaggctggtttggtcattaaagaatggtattccttgtacttataagtcagctcctcaaataacctataaaaaaaaaagtcagctcatcataatgtatacaaaccaactatccactttttatatttaaaaccaaaagtggtagtagtagttgatgtgattgatgtgagggaacaattgaattgttcaacggtacatccttctacttttaccaaccatccaaccacattcttgtactattagcggatttttttaactaaaacgtgtatttgactccatctggcatctactagtatgtaaatagtactcaattaacgtggactttatgctagtgtctgtcaagtatatatagatggataaagtaaactaatggcttcacatcacactttacattatctctttctttgtagttgactttctgctttgaagctaatacacaattcctcattcaaacttcactcatacgtacagtacatcctttctgcttgctgcaattatgtgtgagttcaatttctatcacttcaattctcttctttatttgtttcatatgatgctcaacaaaagtcaatctataaacaaagttgaaactatgctgatttagatgtttctgttaatataattttgcagctggaaaaaaaccttatgctgttgttcagtatggctgtcttcttgtaactcatgcggtaaagaaggcggtagaagaagttgatggaaataaatgtgtatctgattggtttggcaaaggctacatgaaagttgaaagacaaaagaagaaactcatttcaaatcgtgatcgtgtgcgtgcaaaagttgaagcaattgatcgtaaaactgaaaaggttagagatgttgtgtttgagtggctaaaagaagcagacataatcatgcaaaaaatggagaatcttaaattacaatcaaaaccaccatcatggattgaatttaataagttgcaggaaaaaattacagcactaaataagaaatgtaattttgatccattttcaactacaattccaagtttagaacacttctctttaggaaataatttcgagtgtttcaagtcgacggagaaggcttcagatgaacttttggaggcactgcaagatgataattgttgtatgataggattgtacggtaggcgtgactctggtaaaactacgttggtgaaagtaatggaacagaaagtccaatatttgaatatttttgatgagattttatttgtcaatgtgaccaaaaacccaaatatcacagcaatgcaagatgaaattgctgacttcttgaatataagattagatagaaacagtgaaactggaagagcaagaaaaatattatccacaatagaagatatggatcgtccaatacttgtgatctttgatgatgttcgggcaaaatttgacctacgggatgtaggaattccttgtaatagtaatctatgcaaggttcttttgaccgcacgtcgccaaaaatattgcgacttaatgcactgtcaaagggagattctacttgatccattatctacagaggaagcttcgactttgtttgaaaaacattcgggaattctagaagaggatcactcctcctcatttgacttattcaatgtggcacgtgaagttgcttttgaatgtgatgggttaccaggaagaatcattaaggaagggtctttcttaagaagtaaatcattggaggaatgggaaaaatcactacacaatttgagacattcaacagctcaatggcagatgtttctcagttttagaggggaagatactcgctactcttttacaggtagtctttttcaagctttatcccaagggggattcaagactttcatggatgatgaaggactgcacactggggaccgagtttcaccttgtcttagaaatgcaattgaagcatcaagactttcgattattgttttgtctgaaaactatgcaaattccacatggtgtcttgatgaacttgtgaagattcttgaatgtaagaaatggaataatcaattagtttggccaatcttttacaaagtagagccatcagacataaggcatttgagaaaaagttatggcaaagacatggctcaacatgaaagaagatttggaatagactcggagagagtacaaaaatggaagtctgctttgcttgaagtttctaatttgtccggaatgacttacacgactgggtttgaatatgaatttattcaaaagatcgtggaagatgccaatcatattaaaagtcgtttgcaaatacaaagcatatagatttgggttagatacgtagatagaagatgccaatcatattgaaaattgatttgcttggcaatcgtttttggattttggaacgatccaacagtggtcctttttattttttatttttttatttttatgtaaatttgctttgtaagttgtgtatttttcctttgtagtctctcttttgtaacttgattgaatcttgtaagtcaatagatttaccaaattgtccattcagagagaatatattgacccttaatgtttaataatccacctctggttttacagttctagttaaacattgctgatttatttaagtaagtttagacaaaacaaacaatatttctattccaaagaaattatcagctttacatacactccatttacataaaattccaagtccatagagtatatatacaaaaaaaacaagtagtacagaaatgctcaagtttacttgcttttatgacacttaagtaatgcctgtagcagacatgacatgaatctcttagggtgtcataagcatgctcctgagctcatgtttgttcttatcaacgcatcctgagcttatcaaagaggttatccagataccatcggccttaattgactcatcattatcattcctatgccaactccagaaggcatgagttgagtttacaattttcagctcaccatgaccaaaactggcttcacgaaattctgaccactttggttgtggatttatgtacctgtaaacaacaatgatgtaaggatacaggctgcgtgcatgccgataaacaatcttaatagttatatggacaggtttcagacagtaaccaattcagataacaaatttttataatgtgtctggcagatattacttgcctatgagctaagccttctcggtttccaccatcaccaatagttatatggacagcgccacaaggatccaatcttccattatacacacgtttctgtcaatcagataaagcaccacttaagaccaaatttccattaaattgtgcttagaaattaaaataaaggctaaaatataaaaggcctaccgaacgttcataagcatgaacatgtccagcaagaactaaatcaacactggcagcatacagcaatggctccatgactgtcatcatatcatcccctgcaccttggtgagccttgttactattataccacggcacgtgaaataacacaaccagccaaggtgtccttttcctgtccaccttggacagatcttcctatagatgagaaatgaagaaaacttaaagagacagtaaacgtgtctaaagaaaagaacggcacaatagatttctcgtccatgtttgtatcaaaattcaaaggcctgtttggattgacttatttgagtttatctactcgcacaaacacttgtgagactgtttggtagagtttatggaaagagcttgtgacttttcataagttgtttcagcaaatttccataagctttccaagatagcttatgaaagcagcttataacttatatgaaaaacaatttggcttattttatcttttgtcaaagaaataacatacgcataagcacttatatgacaggagctcatgctataagcacataattaagttgtttatccaaacagaaccctagtctaagcctttagcacatgtatgatgcatcccattatacttatcgaaatatacggcgattgactaacctttagccatctgtattgctccgagtacttatcataatctgcataagaccctagcatgataacatgaacacctgcaacttcaaatgaataatagagatttgaagttgatccactttcctcaaacggcattttccatctagaattatacgatacaaattcatcggttaacaatggtatattttcctcttcatgatttccttctgttaccatccacggcctcgcactagcaagcggctccacaagcctaccaaacgagtcccaaagatgctgcatacaatcagcatatgaaagatcacccggaagaaggtaaacatcatatttacattgatcaatgtgatccaatgttgatttagtccaaccagtttgaccaagatcgccggccacagcaaaagtaattggaaatttagatggaggagttttgagcttgaactcgggaccttgtccgccgcatcgataaaaatacatggtattatattccaaaggtccaattacagtatggtgtatctttcctgagctatataacatataattataagaggtgaactctccttcagatattgaatcatatctaccaggtaatgttccatattctacaaatgaaggtgagtgtttgtcatcagttatccatgtaattctcatgtgtctgtctcctgccaaagatatatgtacctgaaatatcacaactatgttatgctcaaaccaagacaaccattctgcttagatgtacggaaacagtcccaaaatgaatgcttatttgttcatgtttggatttttatgagtgtctatatttgaaatgttggaattatgtttggattctatgtacacaaacagttcatagtgacttaactcaaaaacaaaaactgaaacataacttagatttgaaatacaaaactcataactgaaattcatataactgcttttggtttttgaaaatttcaaaacgcaagacagaaaaccactcaagattttgtagtctaagaatctgaaatttaataggtaccataaataaataaataaacatacatagagtgttagcacaattgcttctttaatatttttaaattaatcataataaaaaaataatggttttattataagctagttttagtagcttctgaattttttttcatattttggtaaaaaaataaataaaaaatctcatttaaatgtgtgttagctgggagaattattaaaaaagtacttttattattacaaacaatcacatactatatcataagttctagcttgactcccctaaaaaaaagttctagacaaaaatatggaaattatagataacttgtataatttcttctaacaataacttgtattttaattttaaacaaatgactgtagataatataagcaattaaacaatagttacttaattaacaattccagattcaaaaaaaaataacaaagacaaatacagaagaaactaataataataataggattgatgaaaagtagagaaagagagtttgacctgttgagggtaaggttgggatttagaatcccatggccatggaatgtttaagttttttcttggcaaagggcgaacatattgatcagcagtgacggtcgaagagagaagcattattagattaataataagaagaagaatgaatttgagttccatggtgatgatgtcaaagttggggtgtaacagtaactggtggaaggaaggaagaggacgacaacaaagtacttccacttccgatcttatagttttatcatcatcttaatgatgatgtcaccacattcttgtcctgcgtgtcgccaactccttgtttttattgctttacccgtaaaaacaaaacaaaaaatatagtaccattttttaataattttttttttttaggatattttgtaataatttaatagctaggaattcatctcaatttcaacccttacatcgttttagcaatttcacatttcttttttttgttttgttttgtaaataaacaaattaatgcattttattagttgaatgatatcaaatacatgacaaaacatcatcataaatattgggctaaggtcaaacgaaaatattagtatcgggtttcttatataccttttgtttttaaacaattattttttaatcaaattatgtttcatatactcggtccccctagctttaaattcccgcctccgctcctgttcactatcatcatctacccttgcatgaaaggaatccatgatatgatgtgaatctaatacaaagtctacatatccatatttgaaacagcatataaatgtttattatataccggtacacaagctataagataatatctttttggttctatgaatatttgaactttttgtttcagtctttttaaattttttgattgacttttagtgttaaaatgttttttttttttttgagaacagtgttaaaatgttttacatctttatttctggtctatccttataatagctcatttggatttgtgttgaatatttctataatcacacagaaaagtgaagcaaggatttggagagtttaaattttgcagtgaaaatgcctagaaacgtgtgatcaaacgtgcatctatggttagaaatgggaaaccaaacacatactatgtaaattcataagtataattcgtatttgtgaataaatttttgcagttttttgtaataatattataaaaatctctaaaaagaaaattagattgttttaacaaaacattaattaaatatgaatttttatattttttgcggtttttattcatatacaattcttgttttgataaaagattcaacttttttttaagagattttaacaatattccgcacaatttcatcaaaaaatataagtgtacacacgagttgatttaaaaatgaaataagttttttttgtcatataacatagtggttaaaaccgacacctgctaactgagctatagccaagagcgtaataaaaaaattatttatttttgtctcgtaacctagtggctagaattcaccttataaggtgaataaattgggtgtccaggttcgaaccccggcccctgcatataataatgcattgtcctactaactgagctatgctcacgggacaaacaaaaatatttttactacactaaaatatcaattaattcattttagaaatattattattattattattattattattattattattattattattattataagcacattcaaccattgtaaaaaatatagggttaataagtttttacctcctgtaatatatgtcatttctgattttctccctgtaaaattttgattttgattcaaccccctgtaaaatatttttgttttgatttaccccctaataggccaaacaaaaaccaattttattttatttttcaagaaattttcgtttttgttaaaaatattttacagaggggtgaatcaaaataaaaattttacaagggaaaaccggaaatgacctatattatagggggtaaaacctattaacccaaaaatatataatcataatttatcttgaagaaacccaaataaagtattttaacccgaacccaaattaaatatgctacaaacatttttagtcctagttttaaaaatcggaccggtcatcaaaccgatgagagtactgggtcacaagttgaaccagtaggtcattggtcaaaccgtaagactgaatcgaattaaactggacgactcgattatataactcggtctcaaatacaataaaactcaccccttaaaaaaacactaacgaattcaaatcatatcatacactaaaattcttagtaacaacacgttccaatcaattttacttttgtatctttttccctatttaatttaatatcatttttctgtatatatataacacaagtgtgctttattcgtataaaaaaaaaaatatttgtgtgttttatatttttacaaagagattccttaaaaaaaaaacaaagataaatatatatgggctgttatttaaaaaaaaaaaaatatatgggttgtatctcaaaaaagaagatttatgggacaatataacaacttcctatcaagtgtatttatctagagctgccgtttgtttttcctttctttacatcttcttctctgtttcgccatttctatcaatccagatccgtttttttttcgcctcctcatcttactagtattgacctggccggtttgtagaaacccccggttaccggttttttccagttttcagcggtttacaccgggtcatgccggtttaactgcataaccgatccaatagttggaccgaaccggtcaccctccggttcctggtccaaccggtttttaaaacactgtttttaatacggtaaattctatggtacacccaataaatttgggtgtatcgttacaccaagtcataaaattaataataaatgagttgttttttttgaagaaaaataattattttctatcattgacaactaagataattaaattttatataccaaaagcttcgatgaaataaaatttaattttaaagaatttttactactcataacgatgaatattgattattttttatgataaaatgtaaattttgtaatatgatccttataaacaatgaaatgatggtttttcttatgaaatgatgttttccaaaatataaatattgacaaatacatttttatttcattaaagtaatctttaatttatatattttatgaaacaagagtaccgggacactcaaaattgtgagtgtaccataaaagttcccttttaatacacccatttatattttttttgtatataaaagtcgaaattgtttgtgagatgaacgacgtcgttttggttggcggttagaaatacaaaaccctaaaccctactgcgtaacatcacacttctctttccctacctctgcctctcttcaacctcgccctgaaccaaaacgaagaagaagagcacgaggccacaaaaccctaaccataacctctcaatttgttcatctcaaaactctagcaatggcaacttccttagcttctcaattacaagctatcagatccatagcacttactgattccgcacctcaaaagcgaccgttcactcgtccttctatcttgttcgatcctaaagaagctgctgataagagtactgaatccatttacaccattgctgctcaaggtaatttcatttttcacaatttttatttattttttgctatttttcataagcttacttgaataaactgaatgaattcgattgttgaattgaatttgaatatgaattgtatatttggctgtgcttcaggattggaggttctgattagcaccgatgaacggtttaggaattataagaatagtttgttcagtcccaagagtaaagaattggatagaggattaaagacagaagacgagaataaacaacttaattctttgattaatccgtacttgagattaatttctggatattttaatcttccggctgctcttcaaacactcgagtatttgatacgtgtatacaagtgagaactctatttgatgatttgttttgtttttttttactgtgattgtgttctgtggtttttggtttttgatttgatttgttatgtgtttcagaatacatgagcacaatgttgaggatttgattttgtgttcattgccttaccacgacacacatgcatttgttcgtgtagtacagatacttaagatacggttagaaaaatatgattgtttgttactttctttggttgtgttgtgaattgtaatggttttttgatgtatttattggtttctgttaaggaatcgtatatgggagtttcttaagggtgtgaaagactcgggtgcaacactacctagaatggttgtagtgcaacaatgtcttcgagatggtggtgaattattaaaatctttatgcgactatgtgagtaaaaatacccgtgtgtttagctgtgaatttgacagatgtttaagttaattaaataataagataactatgttttttgttgcaggcatctccatccaaaaatccttcaaggaatgtaattggcttttgtaccgctgttgttgttgaagttttgggtgtgagggtggatgaagatattgtcaaaataatacatcctttcgtgaattctggtcttcagcctgataagaaggatctttcagatcacaaggttagattaaaacttatatatatatgtatgtaatatatatgtatctatgtatgtatatgggcatcatttggtggtttatttgacgaccttttgcttagttggtccctcttactctgaaatgggtggaccatgtgaaatgaattcacctttttcctttttgcccctcatgtcaagatcaattgatatgttaatattcatttttgttaagaaaagaagtgcgattcactgtaatatatagacattctcatgttatatagactgtgatttgttcaatcgattaattgcatgattttgcggttgattatatgactttttaagtcatcaaacaccggaatagcaataccacacaagtatataataaccaaatccacatagttggataatgctgagaggttgttgctttgctgagtatatttcctgtacaatttatgctatgaaggtcattccttacattatttattgttaccctttatttttaatcgcaatagaaatgaaatttattcactaatattaaagaaatattagtgaggacgaaactctctttaaaagaacatgcacttagcaccaaacaaagaccacaaaccaaccgtttctcaaacacacatgtttaaggaaatatatctctatttaagacttttctcccgtcaaatagaccaaagaacatcattcactgtgtaccgctttaaacttgttattctatatctatcaccttgctttttggactaagtttctgcttgcaaacttcccattaggaaggtctatgttagtaaagcttggaggtatagctgggcataactgtaattgatttaattcaggatcaccaatcttgttcttagattctgtttcagatgttacatttttttgtttcatatatattatataattgtaattgacgttatattatatatatatatattttaagtatgtttgtgccaccttctgttgaactattgtcatttcaggccagttcattgatgatagtttgcttgcttggacataaaacaacattagctccatcacttttgaatggtttgatacgttcagttgccgggattgctcgtgcttgtgaggaggctaaagatcttcattggtttcggttgtcacttattgccttaatcaatcttgtccaggtactatgctgtgacagaatttttaattttttctgtttgattaatggtattgaacctattttcttgttgtgtcatgcctattttttttaacttggctatactttcattctttgttgtgtttgaattttcctagtcccaaaatgtggacacacttccaacgaaggccttggatgttttaaagaaactaaggtagtctatctcaaactactcaactttttgatgatccttgtagtttcactgttgccatttgtttttaatatgtatatgcatgacttatgaatcctttttcttatagggatttgcctggagttttattagaattgtctaaggagttcaacattgaaaagtttctcgttgttctgttggactccctaattatctgcaggtgataattctatgattctctttctggtgatcaatgctcagtatactattaaaaacttgtgctttgtgctgattataacattcacagttctaaggatgaagactgccagcaggctttgctgtccttgatagaaaaggtccccataaatgactctgttcatcatgtggttaccaagatcctatcaacttgtgtgaaactatcagaaaaagttggtgactcaacatcttcaatgtcaggtatgtattgtgatagttcagagaatttgagaacgagagaaatttaaaaagaatggaaatggatctgatgaagggaactgttttttatactagtgtgactgctctaattaacaactgacttagttttgaccactgtacacagctcagttcttggcttaacgaccaaactatatagttaatgcaatagttgtaacctggtcaaatatcatttgatgcctagcttattatcctcacaactctttttttctttcaaatgtcaattagctggatgggcaaaagagattctgaaaattgttgatatgaagtatccttctgaactccgtgcagcagttcatcattttcttcaggtgtgctgaagaactttacgcttttctttgttagcaaattattcttagaaagtctgaattgtctgaactctgaacttgttcaacttcagcagcataacacagcacattctaagaaagacaattcattgtataagattttatgtaagatgttggatggcaatttggattcatcatctgatatctcgaagtcaaaagtttggtttggcttgtatcatccaaaggtaccacacactgactttctattgaatattcactgtctattatcctgaagtgtgtattctcttgttcaatgttcctctattttctgttagtacgtactagcttcattcttatttgataatgttgtaggctgatattagacgtactacactgcttgatataaattcttcggggatcttgaaaaacaaggcatttgtttcagaggtatctatgcttttctactttttccctctcctcccaaaatactgatttatattttcatgtgtgagactgttttaagaccatcctcgacagttatcctatgggctgaaaagtttatttattttttgctaaatttggttaattacctatgttgaagatactttacaataatctctgatcatggggcatattgattaaaagttcttgcctatttttgattatattttttccgaaaaggttgcttcacattttttttactgtgtttttgtttaaaactgttcttctatatgttgagttccatttcaaatgatttgaactgattatatttgtaatctaatatgtatattgttgactagagagagtgttaaagccattccacataatcgttgggttgggggttatttgattttgatagaagacttgattaggaggtacaaagtagggggggttatggactcccttgttcaaagttttgaaaaattgaatttgtgatataacttttttaaagctagtattttcaatttgagaaaaagattgtgatttctgtttttctgatacgagagtctgagctgatttgaagttgacatggggtaatcttcataaattggtcaaagctttagttgtgttggatggatgctactagttgttttgtgtgcttttacatacgagaatatgtaaaattgcttatgttatgatctttttgccattattattgtgcataaccgattcctattccatattttaaatccccaaccatttaactattccgttctacccaaaatgttttgttgattagggtcttattgacatcctagaggccatattgagacagtttgatgatgaagatctaacagttgttcaagcagctttaaatgtcgatggcgtggaaaatgtaccagattcttctaagcttctcgaggcactgcaaaatgtgctaagaagatgtgttggcaagatgctgtctggtaagtgtggtatattaaaaataatttggtagaaattcatcttcctcttttgtttaaatgttacattaaagcgcaaacaaacatacatgttatgttccaaagtgaatatggtgactggtaaacgatagcaatacaagtaaaagcatgcattctgtaataaagaagatagacagtacacttaccgattgacttctgatcagctgttgggaatatgtttatttttctcggaatgtactcttgttggatgataactgttagtgtggtatattcatagagtttgattagctcttctgagcttacattttttcctgttctttttgatgaatgtctggtcgtccaattctattattttatatcaaattgtttatcgtgaaatatatagccttaaacccatatattatatttttctgagataatctgttgtttaattagtaccaaattgatgactgcggtgtgaaattaaacccatcttagattttacagttaattacaaagagaggtagtgccttcattagaatggaagaaaaaaagacaatcaattcagtaaagctcttgctttttgcctctgaactttgttatgctgctttaatttttctgagaaataaatgattgttggaccaaggcccaatgtagttaagctcttgctttttacctctgaaatttttattttattaatattccctaacaaaacccaaaggaagttacgaaacaattgacatgtaacattaggagaaaaacaatcaatttttttgctacatctcagttatacttttcaatttttataattactttgggaaaaaacgcctcatcttagaatttgatttaggcctaaatataaattgggcctgccctgcatacaattggtgatttatttttcaaattctcttatgcaggttcaaccgataatgttagtcttacttgcgaagttgctgtcagttgtctaaagaaagccatatcatacttccatgatcagaaattgaaaagcatcgctgccatgatttatccattactccttgctatgccacaggttgcactggactggacttcatatttaatctttattcttgaaaagaaagatttaacatattcctgacttcgtgttcttacttaattgttgcattcagatttatgctttgtcttggtgatttacacctgacaattacttctcttattgcagacacaagacttaaatttaaaagctctggtactagtcaaagaaattaactggcaactttatgataatattgctgaagaaacggtaagtaactacatgggattcagtttgtaatatttttgcattataatgtatacttatatattggaaaaaccgaagtctgttagaaaagccaagtttgtcatatattgattaatttgtattgaaaacaccaacgtctgttgttcaaaaagttaagtttgtcaaattgatgagatagtatcggccgagatgaatatagaatcagtcaggaagtccagtagactttgaaaaaacaaaacttcaaaaattggaagtttacatttttttttcctgacatactataagtttgactgtagaaatggccgaataggaccctgtcgagtaccacgagtatcttgatgttttggcttccactaacttctaaattgttaattacagccagtcatcattacatttcaattcactaattcttaaagttcaatcgcagacatcgatacctggatgtttatcttcaattaacttgaaggttatcgaaaaattggctggcaatttcatggtccaccatgaagataatatagattggtttgttaaaagctgcaatgatacaaaattgtcaaagacgctcttcttttttgttctattgcagtctcttgtgctgataaaaccaaaaggtttgttttctgtcattctgaatcccattttttctcaaatagtacataacgacacaaacaaatggattagttaggtcatatttgttttttaaaaacggggttagagaatgatgaatgctgactttctattttgatcaaaggtgataatgacttttctgcactgtttgaaagtgtgtttcctattctgaaggctgagtgggaatcttcagtgaatgctggtgatgttcttttggacgaggtacggggatatctcatatggtttcttttatttctcttattttttcactttctggtgaaaaataaccttttttgtttgttttggaattgtttgtagttcaattctgaagtgttagacttaaactcggactgtagtgcattctttgatcagcttttgtatgccaaactcggacctctaaatgcaaaagttatgtcttgcatattttggaggctgattaaagcactagtgtcagaaaaatcttcaggcaatctactggttagtacttccttccgtatttgtttggaattcaattttgtcttattggagttgtcgcaaatatagtcagtacatagttagctatgtacctaggtaatgtcataatgcacttaggaatcagcaatatcattaacttgcaaatgtaaactatgtttatgtttatgtttattgctaaaagtgaataagcagaggaaatttctcatatatcctcttatgttcttcaaatgttgttagcctccctctgtgcactgtttgttgcctagttggacgaatgaaccttttgcaatatgcaggatgatagcaagataaaggatctgtttgtattttttgctttgtcaaagttcggaaatgctttccatgaacacctccatttcttagcagcacagttcagatctgcccacctattatccaagttttttacagacgaaggtacactgtactgtttccccgttgcttgatgtactccatatcttaaatgggacaacactgtttacatgtactgagaatttcttacttttgagatagaatatactgtttctttgtaaatgtcaagatctcacatcatacataatcagtacatttaaataaattatttgtttaactacgaatttaagctttatgttgctcttattttccaggtgacatgttctataattaacattttatggttctgaagcattgcacattggcttgattcttttttgaatcttttcctgtgtaggtgttcctgctgtagtccaagttgaaagtctgcagtgctatggatctctttgtactctgcagcaaaatgaatgtcaaactgatcttttggctgaatttccttctcttcttgttccattggccagtgatgataaggtacgagtctgtgtgtatattttatccttatctgcttgctgcatatatatatggttgtggacaaatggttatcttgttttgtatttcttatgctacttaatcatatgatggatgttctcttgatttttgaggaaatctggtttgctcaaatgatatatgttcttcttttgaaattctttgcagtctgtaagggatgcttccttggagtgtattgttaagttacacgccttgtggggtcgtattgaacatggtatttcattgtcagaatagatgtatttaattaccctttatgcctaattattttctaccttcataacttcctaaactggttacaacagggttccagtttctggatgaacttctaactgcgttggttcagataaaaaaacttatattgtctgacaagaaaattctctcagcgttgttcacgtcctcactggggtccacaccgggctcgtcctatcataatatcctattacctccaaatatgcaaaacaggtatataatgttactgggactatttcatctgaatggctccactttatcacaacacaactatttgatatgttactgggactatttcatctgaatggctccactttatatcacaacacaactatttgatatgttcacttgcttagctgcttctgttattggaatttgccagatctttcaaatgtgtagagggggaatttggataggtcttttttttatttccttataatgtgtaaaatattgacatagattgtgtgtcctggctttttaaagtatttgagctgttgcttcgattcgctaagaaagtatagattagggtttagggatattctgtggtgatcgactccatattaatcaatgcaaatttatatgacatgtttgatatctttctatgctaattatacttttttcatttttggtccacttttttttgctttaacttgagtatatcttattaagtttgtttgtgtaattttaattgataaattatttaaatattttatatgatttcagactcttgccaataataaaataggatgtatcattttatctctctctctctctctctctctctctctctctctctcccacttgcatgttaaaacttattgtagagttaaaacttaaacgattaattaaattttatttcctaaaataatagcgaatttgttgaagggtaatttcctaaagtaatggcattttgttgaaggttaattttgaccggaagaaaagccacaccaaaaaaatgtatcctctttatcaatacttagactcaaagtgaacattcatttgtatttacttcagagatttttacctgctttatttttggacataattttcaggtttgctaaaaaagaagaaatacttgagttcattttgggttatactgagaaattctccaactacgggaaggtttgacgccttcacattgattctcttctatgtttctgttaatatgattttaattgtggtaatagcaatacagtttgtagttttgtttcatttccagatttaatagctttagtgtgtgggttgttatgcaaagccaatattgtaagaaagtatcttatctttgggcattgatttctatggcagctaatgattctctccttgctcaagggaattgggaatcctattataatgcatcctaaaattgcatcaatgctgtctaatttaatggagagatactatgataaacacggcaattctttccagaaattttcgaacactgaaactaggatactgtgtcttttgttggaggtgagtgtacttcaatattatgtcttagctctgatgaaacttccaatctgaggtttggtgagctaattccttttctccatgtagaactgtgtaatgtcttctccttcaggtggagatgatcttcaaaactctttactgaaagtgttgcaggtgagatatgtagctacatgcttttcatatgtcattcccttgcttgttattttgaatttactaaccttggtcattgcctttttcagttggatggcatgacttcagacaaccctgcttatgtagagccttgcatcactgtcttgaaaaagcttaatagtcaattctacacgggcttgcaggataaagcaaaggtcttatttgcatcaattatttatttctagagtctgttctctttcatgataagtagacatgtacaatctcttggtgtgatgaattaagatgaatttttaatttgttaaatgaaatttttttattaccaatagtctctactgtaacctaaataaactattgattttttcttgtatgtcaggagcaattatttcttgcacttgtgtttttgtgccgcaatgctattgaattatgattttttaatttgttaaatgacttttttttattaccaatagtctctagtgtgacctaaactattgattttttcttgcatgtcaggagcaattatgtcttgcacttgtgtttctgtgccgtaatgctaatggtgatgtacaaattgcaactagagaggccttgatgcgtataaatgtgagtttcttgcttttggttattttttatccaacatgtcttgtctcaattaaggttcttttgtttgttttccactttggtgcctgttttgtatttctttagtggttcttgcaatctaaaaagaagacagcaaaatacagctcttaactactatagaaaagtgcggcacccacacaatcatctcaatgtttttctaaatggacctcatttgcttaaactatatttatactagagtgctgtagacatagtcctaccctaaaataatccaattgcagacaagttcttcaaccaatgcccttagggtgacaatcgacgtagactgcgcattgcaacaaattcttttgccttcaatttttagatcaagcatttagaaactatttcaaagcagggcacctctagagcttgctcatgaagggccccaagtagtgccatgagaacaccgctcgggcaacgacccggaaagaatcaattttagtctttatggataatacctgatcaatttccttttctagtaccctacccccaggggagtcgaatccccgttgcctccttgaaagagagatgtcctaagcactagatgatggagtcatatggcagtgagacttaagagaccaaggccatccagaagggtaattagggtctgctgctgaaccagatatcccgccccttacgacctgtaatcgatatccccaaagaatgaaagaagggcagaagtgaatagttggttgggatgctacgagttcattcctgtccgataatgtagcgacaaggtcattccttactcataagagaccccgctcactgccaccgctgtgaggggcgctttaacatgcaaaaatgctttaccggatccagctatgcaaatcgcggaagagcgtgacgtccataaactaagatttattagaaggtgcagcgttcaaacaaccttctcttggttccgcttctaaactcaaggaaggcctctaaagagagggaactcatagttcttttctaagccttcagagaggcagcgcaggtgaatatgcggctccgtactggggagatggagattgttaagagtttagcaggccgaggaaaaagggcgatttagaccctctaagactatacttctttgaagtgaatgggtgcttccagttcctttagcaagacatctataataacatcttccttagtccggataaggactaataaagtagtaaatcattatcatcaattttacagagtatggttattctgacaaatcaattgactatggtgattttgaacttccaaatatgttttcgtagaggaagtctgagatggcttggacgatgagtaaaaatataactgaatattaatgaaatgtgaaaatatgccgggaaaattgggttgacaataacatgtaaatgttgggaactatacatcatgagaaattggtagatcttatatttagccatgctattcttggattatgttagttttcattttggacaatgcctgtttttctggtattatattttaaatgtgataaataatgttacatcattccttctgtcaactgcgcctgccaactattaatttttaaaatgaaatattaggataaatgttttcttttgaaaatctttacagttaacatttaatgatttaaagtccgtgttcgctcaatgaccataacattttgggttgatgcgttgcgtttttttgcattatggattttattttcagtttgtttttttcatgcttccatttcaaagaatgaactgagaataattggtagttttatagaacttccatttcaaagaatgaactaaggataattggtgttttaatggaattgcagatagatttcaaaactgttggccgcatacttgaccccataattgccccaaagtatggcaaaattaggtcagcagatgaaaagttaaaaaagagacagaaattgacaacacatcatgaagaagaacttgatgacatatgcagaatagataatctggtcgacagtcttagttcccttcttgatgttttgttactgaagaaagacatagcaaacaggtaatttggttattacgttagtaccatgccagaaaagttggacacatcatttcgttgtgctaaatttgccgtttgattcttgcaggcattctctcttagaccctttatttaaacttcttggcatggtattttcagaagaatgggtaaattacactctttcccttgaggaaggatcatcccaaccgccatcaagtcttttcgaaactgtaaatcatattcaacagactctattgattatcctggaggatataatcatgtctcatgatagcatggctgtgctaaatgtatgctttctacacgtgaagctgtaatattttatatagtaatggaaaatttatactacctcttcactcttttttctgcttctttttattaatttttcactcgtgacaggaaaaaatgactaatgagattaatattaagctactgatagactgtgcccggactaccgatgttgttgtcacccgcaaccatatattttctctgctttctgctgtcattagagtcttaccagaaaaagtgtttgggcatctaattgatattcttccagttattggaaaatcagctgtcacacaggtttgtaaatgctctcgcttaccccatcttttggtttccctgctttttttcaatccttgattttcatggttgggtccacattaaatcttccaacttatgtaaacttttacttgcaagttttgagttttgaatattcaaaataaccatgtatcaccacttatgtgtttatgtacgtgtagatcgacagtcattcaaagcatgtatttgaggatcttatatctgcgattgttccttgttggctgtctaagacagatgatgtggagaaattactgaaggttggtttttcaagacaatacttttgggctttcatgactctccgacacgagtggaagtaacttagtagatcaatcttctgatatttttttttcttgattcaggttttcatagatatatttcctgaaattgttgagcacagaaggctatcaattgttttatatctcctacggtaatttatacatgattatcctagtattgtaacttaaccatttttttatgatctgcgtcttacattggtgactattttgcagaactttgggcgagggtaaaaaatgcttggcctcattacttagattgttgttctcttccttagtttcaaggaacgtcacctattttctcaatattgagacgccagatgctttaacattatgtactatagagtgggaatataaattagcagtgcagatttgtgaacagtatgcaagtatgacttggcttccttctttagtttccttttatgaacagagaggaaacaaaaatgttgaccagtcaatgtttctggagttgtttctggcaatgcgcttttgtttgcagaagttgcaagatcctgaattgttgttcaaactagaatcaggagtagactctgttgtcattcaggtattatcctgatcacaaattatgcaacaaagttttatgccttttaatttcttactttgttcaattatattgggcaaagtcttgatggtagttaaatcatgatttttttttaaacgcatcagtgttgaatgaccactgcaaattaatggtagtagatgtggtagcttatctcatcaacataatcgagagattgatatctcatagttgataaaatgtgatggattgcatggtgaaattgttacacccttcggtcactattgtaggtaaagctttgttctttaggttcattcaataaatgatgcatgcggtctatattatagaccacattcatcgcttattcaatgaaccaaaaatgtgagtttttgcttataatagtgtccagaggtgtaacttttagcaaggtactcgtctttctttggctaatattaatgctgaagcagtcttggcattatgaactgaaatatttaatgtacatctaattgttagatttttctttgtatttttttttcttttctgtgatgctctttttggttactcagtgtgatatcggtggtcttgcatgcttttatttgattgaatgttctattctttgattagtctgttaacatttatgttcattccaaccaaaagattcatattcttattcaaaatgtatgtgatggggcattaatattgcagagtcaactcagagagcttatggaacatgttgttttcctcttgcatcttgtagatgcaagaaaaaaggaactaaatttccctgtcatcatgaggaaagagttgaaggaaactatgcgcgctgttgtgaggaatataacaatggtcatgattccttcaatatacttcaagtgcataattaatttgctccatcattcagataaagatgttggagaaaaggtatgatttttttatgagattattccaaatatatgaaaatttatttaaagcttgcattattgagataatatgtgaacctgtctttattcttgtcctagttttagacaccaggacattggatttaggatatatattgctttatattaggtattaaaacaagatcatagttcacataatttatctatgccattggatctactatatatagggaaagttctattttagttagtttgtaataaatacatatcttggtaaacaaattaagagtttggaagcaagacattggtaactgttatctgatattgcattgcgtgtactccaggctcttgggctgttatgtgatgctgcaagaaatcacgcaacagtcagcttaacgtctaaaggcaacaaaggttcaaggtcaagatcaagttctcgttggcttcaattggatgaaagttctcaagaatcacttgataatatgtgtgtagaaatttgtaaagtacttgatgacgattcatcaagtaactccttgaaaatggcagcagtttcagcgttggaagttcttgcagaaaggttcccttcgaatagttccacctttgttgtatgccttgaatctattattacaagatgcaatacatctcagaactctgccatgacttctagttgccttcgaacctcttctgcgttgatcaaagttcttggtccaaaagcactgtctaaacttgatcaaatcatggccgtgataaagtcctctaaggatttggaaccaaaagctaatgatgtttccccagcctcaaatgcaccccatcttgtttctgttcttgttactttggaggcagttgttgacaaacttggtggattcctaactaaagatctaaaaaatatcatggagcttctggtgcttcgtccggaatatgtctcaggaatagatgccaaagtggaatcccgagctcatggattacgaaagcttcttgcggaaaaaattccagtaaggcttgctaaaagtatgtattgtttgatggaggtagtgtgaaatgagtacctatttttctaacttaacatcattttattacaggtacggcttgccctgccgccattgatagaactataccctgctgctgttgaggctggggatacaagcttaacaattttgtttgatatgttggcaacatttattggtacaatggacagatcatctattgtggcattccatggaaggatttttgacttttgtttggttgctcttgatcttcgtggaagtcctcattcagttcaaaacattgatttagtggaagaaggtgtgaagaatgctatgctggcactgaccctaaaacttacagagagcatgttcaagcctctttttataaggagtattgagtggcttgtcgatgaaactgtatcttcaggaagcatggatagggccatatctttctatggcatggtaaataagcttgctgagaaccatcggtaagtcattgcctaatgttttatattccttgttagataatgttatttgaaataagcgtgctttatgaggttatgaaagtcaaaagacactttgtttaggcatctctagattttgtttttggtattttgtttttcattcttaggagaatagtttataaagtagtgtattgaattgaacatatttatgtcaattcttgtcacagttgcgatgcaatttgctcacaatatatattgaaaatttaaacatgggtatataatttattattatgacattttttttggaaataataatcataccatatccttttcttatttctaggtcattgtttgttccttacttcaaatacttgcttagtagctgtgttcatcatcttggcgatggcggataccttaaattgtttagttcgagtcagaagaaaaagaaggctaagattttgggtgacggcgatgtaaaagaaacagatgtcttgtctatcaagggctggcatctcaggacactggtcttgtcatccttacacaagtgtttcctctatgacaccgggagcccaaagtttcttgactcgtcaaatttccaggctagtatatttttccattgcactatttattttaaaaatatggagttgtcattaaaatcttgccaatatttgtttcatgttgtttgaatgacccttttcatcgagtgaatttttgtcatcttagtttgtgaagttttccattccatctaatattactttggatgttatcttcattttttctatctaccttataaataaatattcattttaaacagcgagcctcagcagtgattttgcttgtcacatatcacttcactgactttcatatgatgcttgttgcagatgttgttgaaacctattgtttctcaacttgacctagacccacctgcttccttagatgaccacatgaatatacctagcgtgaatgaatttgatgacctacttgttgtttgcatcggtcaaatggcggtcacagctggctcagaccttttgtggcaatctctgaaccacgaagtataatttgtgatattttcctattctcctattttgagtaacacttaagtaatcatgttaagttattgccatcctcatgcagcttacaatttttttgccttaattttcttttgcaggttttgatgcagacacgtaccgagaagacgcgagttagaatattgggccttagaattgttaaataccttgtagataacttgaaagaagaatatttagtgttagatgaaacaattcccatcctcggtgaactgcttgaggatgtggaactttcagttaaatctcttgcacaagaaattctgcaggaaatggagtctttgagtgggaagagcctttgagactgcctatgatgttagattcgttgagctagaattgtgtaatcatataggaaatttattgtgtagaccaatgaacatattatggtcatttaaaggaaaggtggcatttttgatactgataaaagtttaaagttcaattattttcttgtgtaatttcaagtttattttttcttccacaagtgccgatcattaaaagcgtgaatcctttttaaatggaatcagagatcagatttattaccgattaatttaaaccaagtctcgttatatctcatggcatttcttttatgaatacagtcactttgctagtcttcaaactatctttctttcaccaatttattttccgaacttttctaataaactaaaatgttcttaacctatggaagatacctcaattaatggcttatgaaaaacaacaatattctgttagctgagggactaaatagttagatgtgagaatagttcggaggtttttaatagccttgggatgattaaatcagtgagagtaaattgactgtttaatattgattttacttttattatagtatcttgtatccagtctccattaatacattgaaaatgatattatttttttcgatctcttgtggacggagaaattgtatgtttgttgatttcgtgcattaccggatctgtttaaaagatacctgaattacgcaagaaacattagatataacgagatttagtttaccaaaaaaatactaattagtaccagtttagactaaaataaaataccctgtgtaccaaaaatgtcctatttttttagcagataaacaaaataacaataacaacttaattttggaagtaaagagttgggattcaaacttcgatcataacatctgatctagtaatttcaacattttgtagataatattccctcactaatgtcattactagatgtgtcaatgataattaatagtgataaggaatgaagagcctaggtcagacgttaaattaattgatagtgtagtaggagtactaagtaatagttttgttcctttttacagagaataatagtttagttttaattagtcttctacctgtctcatatggcggtatgcctaaaaccatggtcagcatgaacatgtacatgatgatcacgaacatctgctttacgatgtttttctgagttttagaggatccgacacccgactcggcttcacaggaaatctctttgacgtttgtgctgggaaaggttcaaaaccttcatggataacgatgaactcatgagtgtgcctaccgaattatagcctctattttcaaagcactggaaaggtgaggattgcaattgttattttgtccagaagttatgcagcttctacatattgtcttgatgaacttgtcgacatacctgagtcatgagtgtaagagacgaaaaaccaagttgttttcccaatctttaatgatgtcgatccttcagagtataggattaagaactcaacgaggttgaaaaaacggccttcattttaaaatagaggcttaaaaaccaacatattaaatttaaggaaaaaatgttttaatttttttttttggttgttgaaaatatgacctttttaaaatttgttttaaaatatgtctttagtcctataaattataaatttttaggttaagctcttaacaaaaaaaaatcaatttttgtcttgataagtgtttttagtctaggatttaatccctataaaaaaaatggttaaatatatttttggtctctataaatatgtcaacttttcgctttagtccctctataaaatttcttcaatttttagtcctccaaaaatatttcatcttcacttttgatctatcctttaaagtaaactcatatgtagaattcatatttttgaataaaactttcgagaaaaatatataatattataagaatctctccaaaaaaattagattttattttaccaatacatgaattatatatgaatttttatatttttgacgataaaaaatcatatttaatttatgttttgttaaaaaattttaattttcttttgagtaaattttacaatattctatacatttatgcacaatttcattaaaaaatataaaaaattccttaaaagtagggaccaaaagtagtgattgaaaattttacagggactaaaagttgaaggaattttttagagaaactaaaacaaaaattggtatatttataggaaccaaaaacatatttaaccctaaaaaaagttaaggactaaaattaaacaaaatcttatgaacttaacttaaaatttgcaagtgttctagagactaaaaacaaaataatttgaaaattagccaatacatgaaaattatcttagagaaccaacaaatgataaaaattgaaaatagttatttaaaaaatttgggcaaaatgcttttcaagatcaattttatccataattgactgtttacaaaatagattaataatgtcttttatgatctaaacaaataggttatttgcaagaaactcatttcctatttaatgtccctgactattttgttgataatttttgttgttgaaaaagttttctctataaatgttgttgagaccagaagtaccaaaccgataaagataaatctatcaatcacacagtaattttttttttttttttttaatcttatttatgctaattttcgataactaaacttgtttgaaatatttgaatgtttattatttgagagagtggaatataagtacatatcaaccaactttttttttttaaggtagccaaggctacccttcttcatgatgggttactctcctgggtaggtaccttcaaaccgaggacaaaatatcactgcttcctccgtctagtccaaaagaatgtctcattttagtatgtttattttactatattaacgactatattacttttttttttcctttttcaatttatctaattttttttttttttttgttcaagtagtctagtggttagagttcacacaattaaacgtggagagtggggtgtccggagttcgaaccccaacccttgcatataatatgcaatatccctaccaactgagctaaactcacggatattgttttctttctattaacactaatgaaagataacattgtaaaatagcatataaatctcccaaatatgaacatctatgtagctacaccatttaattggatttgttattttaataaacttaattgcaacttttttattgctaattggatttgttattttaatcaaaaataacaattgggtttgggttgacttattcccgtttataaaaaataaatacactttcatgaatcatctaattttgtcatattgataaaattatactactagtaaaaggacggaaggattaaatatttgaattttggcataaccgaaaagatgcttctaaaagtagaagttcagagttctcttcatccgataaattaaaccaaaataagcgagaacaaaatattcacatatgaaaactgaactcatatattttttattggtcaaacaaacatacattaattaggtctcaaccgtaaggacaaaatggagtgttgtttgttaggctttagaactcttgtttaggactttatttatgtttgtcaatgtgctcgaatacaataatagactttgctaattaaaaggatttttgcattcatagattcgaatatgaactcatccaaaagattgtggagttttttgaacaagccaaaagattgtggagttaacagcaatcgctatgtttttctaagtttttgcggggaagatactcgctactcctttacgggattcctctatcatgctttgtgtcgtgagggattcaagatcttcatggatgatgagggattggagggtggaaaccaaatttcacaaactctactcaaagcaattgaaaaatcaaggctttcaattgttgttttgtctgaaaattatggagtgcaagaagacaaataatcaattggtttagccagtattttacaaaatagaataatcagatgtaataagctaccaaacaaaaatttatggtaaagccatgaaagcacatgaagacagatttggaaaggaatccgagaatgtgcaaaaatggaaatcaactttgtcagaacttgccttaatgaatactatagattacttttagattgcattaacgtttttaatgagaaactgttcttggccatagacaaattaaaggtattatgtgttgttgcagttctgtttttggttttagtgaagttttgtatttgataatcttgttttattaaagatcaagttatgtaataaaatttgattaatagaatgaagtaaaaatggtgttgtgcttttgtaggcacgaatatgaatccataaaaaagatagtggaaagggccattgaagctaaatatcaaatgtgataccaattagtccttgcacaaatgataactagaagaaatcttcggtatgtatggtttttacttccttcctcgtaaaaggtagagggaggaagggtcttttgctcatttggcacacttgtctcagtatcgtgggagttaaggaatggtgatattttcgctattgtaattttgcctgaattgcaagtaatggttgagcgcataaatgtcatatcattaaatagttcttttagagttggcattatctattttttgaacttcatgtgttgtcatggctttaccatgtattggctgatccagttggctcttgatcttcttgcacttcataatctttaagtttatcaagacaccacttggaatatccgtagtttacccaaaaaaagcaattgaaaagccttgattgttcgatttctttgagaagagttagtgaaacttggtttccaccatccaatcccttatcatccatgacgattttgaatccctcacgatgaaaagcatgatagataattcatgtaaaagagcaacaaatatccaacctgcaaaaacttataaaaacattgtagcagcgcaggggttgtatcattaactccacaatctagcattccaatggttattggtgcatgatcattcaatagcattattcttcatattgcaattgaagagataacaagtctgtttggttcaatgggaaatcgcagattaagtttttctacaattttagggagaaaagtaagctatttttttcaagattttaacacctttggattctagaatccaaactgaaaacaagtgtttttaacgcattccatttttgggatccatacatcttatttccatgcttcaaaccattcttctatcaaaaataaatttcatattttttttaatgattttttagcacaaaagaggctcgaggcgcatgtaaatgaggtgtttaaatccaaaaattcgaatgactcggttttatatatttttatcaataaattactagcataagaggggttggaagcatgtaaaaagaggtgttcatattataaattttgaattacttttaaactacttttgttccatttagattctagtatcgaaacatgtagaatttctgaagaaaaacagttagtcacggtagaatcacattcaaaataatcatggttatttgtttttttctttggatatgacagaaaaacacatttcatattttataataaaaaaattcagacttaattttaggtttttaaagagcccacaaaaaggatgatactataagaaattatgtacttaaatagcgtagtcaatgccgtgggatgcaatgtctgaacatttttatttcccaaatgaaagtggatagtacttgcaactttatattgttttctttttgcaaatagcaactttttattattgtttaatgctatttgaatttgttattctaataaagaagaaaccaatattgcttgggttggtttccactactatactataaaaagagttgttcatattatagaatttaaattgcttttaaattacctttgttacattcggattctagaattcaaacatgtaagaattttgaagaaaaacagttaatcctgatagaaccacatttaactaaagagaaatgatatctgtacagctattttataacaacttttatgacaactttctctctcatactcacattatatttctactttctctctctattactttgatttttgtgccgatgtatacttttctttctaaaaacatggttatctatttgattgtcaagcaaatagatgttcaaataacactattcttaactaaaacaatcatggctatttttttttccttggaatgacagagaaacacatttcaaattttaaaataaaaaatttagacttaattttgtacttatatagtttagtcaatgtcgtgggatgcaatgtcagaacctttttatttaccaaatgaaagtgatagtatttgcaactttttattgtttttttacaaatagcaactttttattgtttaatgctatttggacttgttattcaaataaagaacaagtcatctttgcttgggttgacttctactactatacgataaaaagaagtgtacatattatagaatttatattacttttgttccattcagatactagaatccaaacatgtaaaaatatgaagaaaaatagttagtcacggtagaaccacatttaactaaaacaatcatgattatttgttttctctttgaaaatgacaaaaaaaaacacatttcaaattttaaaataaaaaatccagacataattttgggtttttaaagagccaacaaaaaggacgaggctaaagaagttactccctccgtcccaaattgtaagaagttttggctatttcacacatattaagaaatgtaattaatattgtatggggaagagaaattatgagttgttttacaaaattatccctaataaatggtatggaaaagataaatgaaataattaaaagaagagagagtaattaataattaaggatataatatgaaaaataacattaatatttcattggtattgtaaagcgacatataatttgggacaattttttttttcaaagcgacatacaatttggaacggagggagtatgtatttatataacttagtcaatggcacaatgtaagaacttttttatttcccaaatgaaagtgattgtacttgcaactttatattgttttctcgctaatagcaactttttcttgtttaatgctactccatcccttaaaactgattcagttgaccttattacgcatgtcaatgcataactttgaacttaaatattttgaataatatattaggaaaaattatgaaaatttgatattttgaaaatactcattgagacgaatctaacgacatcttatatgatgttatttatctttgtactatattagttgaaaaatacggtcaaagttagttaggtcaaaattaaaaaaattccaaatgggtcaaatattaagggacggagggagtatttcctatttggatttaggcattgctcgtgttgacttctactatatatatcttactataaaaaaaaaacgtacttcagcaaaattttataattattatcggttaaacttataatctttttaattttatgggttcaatcgtcattttgtagaataaaaaactaatttattattttttgaaaatttatttatttttgtttatcttttaagtgtaactaactccctacatgtcgtcattttgcacatttatcgtgattttgtgtttatcactttccaaaccttgctaattccgtattttaattttggcttaaatatgataatcgtccctgtaatttgggtcagttttgattttcgtccctgtaaaaaaagaactttgaaatacttccctgtaaaaaaaaattgtttgaaaaaggtccctgaccccacttcatgtctgacttggaatgtaattcgccatgtggcagttgctgactgtgcaacttttgccacgtggcagtccacgtaattaaaaattttaaaaattatttttttaaatttaaaaaaacataaaatatttccgagaaaaaatttgaaaattaaaattttcgaaaactatattttttgacataaaaaatgttaaaattataaattttgaaaattaaattttcgaaaaaacaatttttttttaatttgaaaattatatattaaatttttttcgaaaataatgactattatattttcaaaagttataaatttaaaatttttgaaaataaattataatttaaaaaaaaaattctaatttcttgttcttttacgaaaattttaatttttaaaaaaattattttttttcagaaatttcagaatatattttattaaaaaaattaattttattttgaaaattatacaaaaaaataaatcagaaaattattttaaaatttatattttgattttttcaattttttaatttttttttcttcatattttttaggtgaattctagggtgatggttcaattaaataattgagagccattagatcaatcaagcacatagattctattataggctatctgcactagatctttttgtatgttctctcccatcttctgctccccttttcccattcctcagtgaccgcatttacataaacccatctcccttcttcgtataattatttgggagttcattggttgtgcatccttccaactttaagattataatgaagagaatgaagttgttgagagaggttttgattcatttacgatttaaaaatccttcatgcttcattattctcattgaaattatgaagataaaagtttattttttaaattatcaaatcattatgcattgaatttgaatgaaatcaaggtggattgtgaatcaattttgttgagaggggtgtttacttacaacaaattgtaactcacatttgcttaaccaaacatggtgagaagtgatagcgcagaaaaccagaagcggaagcttgttcagaagctctgttcagaagcttgttcagaagctctgttcagaatcagttttagaagtagtttctgattctaaggttttgtgaattatagagagaattgagagagaagaaaattatgatgaaattgtaattgattcttattgattctacatatgaaaatgtacaaaggaggtagcttatatacaatatctaaccaagtttgcttgaagcacaagcaatgtaacaaactctagatcttatctactagcctctaacaaacttgtaacaaactaaaacaaaatgtgattaatctctgattgtgattatcactaaactaaacttgaattaaaacaaactaacatcctcccttaattcaagtttccacttccttcattccaatcaagcttctgagcttgatgaatctgtcaaccttcaatgccttagtgaatatgtctgcaagctgcagcttagtagagcaatgaacaatctgcagtgctcccttgttcacttgctcccttagaaaatgaaacttggcttctatatgcttgcttcttccatgcagaactggatttcttgctaagcttatagcagatttgttgtctatgagcaattctataggtctgctaacctctatctccatctccttgagtatattttcaagccatattgcctgacatgctgccatacaccctgcaatatactcatattcacaggttcttcatcttcattcatcaccaattttacatttgtctcagctggtgatgatgatggattgcaactcatcatattgaacctcttcaatatgtcagatgcatacttcttttggtgcatcaccaatacctctacaacttcagtaaattccatgcctagaaagtatgtcaattttcctaaatctgacatttcaaactcactcatcatctgtgatttgaatgcttctatctcattcatatcactaccaatcactatcaaatcatcaacataaagacagatgagtagttgattaccttcacttcctttcttcacatatacaccatactcagacttgcatttaacaaattcttgctgcacaagaaagctgtcaattctcttgttccaagctcttggtgcctgtttcaatccatagagagctttgtgtaatctatacaccatatcctctttccctttgattttgaaacctggcggctgtgtcacatacacttcttcatctaaaggaccatttagaaaagcagattttacatccaaatgatgcattggccagtttcttccacaagctataacaactatcaatctcacagtttccaatctagcaactggagcatatacttcaaagtaatccataccagccttctgcatgaatcccctaaccactaatcttgctttgtgcttggctacttcaccatttggcttcagtttcaatttgaaaacccacttcacatctattggtttcttactagcaggcagttcagtcaacttccatgtgttgtttctgttgattgagttcaactcctcaatcatagcattcttccacacatcttcattcaatgctacttcatagttgattggttctgcatctgctaatagtgcaaaatgaacaaattctccttcttcattaactatattatctggaatgacttcatgtccagctaatctagttgaagcaaatctctgtctcactgaagttctagtgacttgattctcttcaacatgcacttcaggttgaacttcagtatcaagttgaacttgttcaacttgatcatcatcttcaattattgtgggaattgtgtgactggaactcttctctttcttagtccaatcccatgcttcattttcacagatctttacatctctactaatcactatagagtgatttagaggatgatacaatctgtatgcacctgtttcatgatatccaaccagtatcataggctcactcttgtcccccaacttcattctctttgcatcagggatatgcatatagcacaatgaaccaaaaactctcaagtgttttgttgactgcttgcatcctaaccaaatttcttcaggaatttgattaagtttcttagtggagcatctgtttaagatgtatgctgcagttcttactgcttctccccaaaatgtattagacatcttcttcatctttagcatacttctggtcatgtcaagcagacttctattccttctttcagccaaaccattatgttgtgaagtataaggagcagtgacttcatgcacaatgtcgttgtcttcacaaaacttctcaaacacctttgaggtatactcaccaccaccatcagttcttaaaatcttaatggatttaccactttgtttttcaactaagattttaaacttctggaacatatcaaatgcttcacttttggccttaatcaaatataaccagagttttctgctaaactcatcaacaaaactgatgaaatatttgtttcccctaatgaaggaacttctaaaggaccacacacatctgaatatacaacattaagtagctcctttgatctacttgctgaacttgaactgaatgcacttctaggttgctttcccaacaagcaagtatcacaaactgtgttagatatctcaattttaggcactcccagaatcatttctttatcaaccaattggttaagacctctaaaattgagatgaccaaatctatagtgccataaccagctatcttcatcttttaccatagcagataaacagttcaattctacaactttcatattggtctgaaaagttctattctttgcaagaggagttttcaaaactaacctttgatgattatcaaacaacttaaaggtgttgtccttcatagtaactgagtatcctttatgaatgaattgacctacactcagcaagttgcactgcattccaggaacatagagaacttcttcaattattgccactttcccattctttccttcaatagcaatgttccccattccttctgcaactaagactctatgatctgcaagtttcacctttgtgtttcttctagaatccacttctcttaacaatgtctgagttccagtcatatgattagaacaaccagtatctaagaaccaactttctgaattggagctctcattactagttgttgtaaccatcatgaataatgactcagaatctgaatcatcttgagcaattttggcttcttcttcatcattctttgattgctttcctttactagaccaacattcaaaggcataatgtccaaatttctcacatttgaaacactgaatcttcttcttatcaactttcttcttttgattagaatttccttcctttgaagattcacctttgtcagatccattgttcttgcctttagaccagtttcctcccttagagtttttcttccctttcttgaagttcttcctatcataatcatccttcttgatagtttgaacttgcagggcttgttgaattgatttttcattgcttctttctgaaaccatcaattcatgagcttctaatgaactctgcagctcctcaatctccaatgtcttaacatcttttgattcctgaattgctaccataatgaaatcaaaccttgaagatagggtcctcataatcttttcaactatctgttgatcagtgattgcttcactacaagccttcatctgattcacaagattgatgagtttagagatgtattcagaaatcttctgatcatcttccatttgcatcagttcaaatttccttctcagtgactgaagcttaatcaatttcactttatcatcaccttcatggtactttgaaagaatgtcccatgcttcctttgaactcagtgattttgagattctttcaaagtttccttcatcaagactttgttgaatcaagaacagagccttgcaatctttcttcttcaattccttgtgtgcgttcctttgtacttcagtggcattcgcagctaattcacctacaccattctgcacaatttcaagcaaatcttgtgctccaaacagattcttcaccactgcactccatctttcccaattgcgtgcttcaagaattggaagatgtgtgttgaaactgctgctaccattcatggtgtttccttcagcgtttcttcctacaaattgcgtgattgaagatcttgataaccccttagaacgaaaccaaaggcacttgatgccaatttgatagcgcagaaaaccagaagcggaagcttgttcagaagctctgtttagaagcagttttagaagcagtttctgattctaaggttttgtgaattagagagagaattgagagagaagaaaattatgatgaaattgtagttgattcttattgattctacatatgaaaatgtacaaaggaggtagcttatatacaatatctaaccacaaacaatgtaataaactctagatcttatctactagcctctaacaaacttgtaacaatcttcataacaaactaaaacaaaatgtgattaatctctgattgtgattatcactaaactaaacttgaattaaaacaaactaacaagaagaaacatatggaacaatcgcattatttcaagtccatattccattacacaccttcagttaatgcttaaagcattatgttgtagtgtgtcttggttaaaataatctatggcagcaaccatcttgtgcagaagttttggttagaaaggaaccagatggggaagagaaaaggaaaggaacgtgattttgtgtagcaaggtaaacttgttctcatttttaattttcaacaaaatctaaacgttaattaaatctaacgttattttattcatagtccaccggtgaggaacttaattgaaccctcaccctagaatccaccaattttttaattttaaaaacaattttcagaatttttattttttaaaaaatttaatattatgtggcatgtctcgtcagcgccacgtggcaaaagttgcatagtcaacaattcccacgtggccaaaaccatgccaaatcagctgaatagtggggccaaggacctttttcaaacaaaaaaaaattacagggatgtatttcaatttttttttttacagggaccaaaatcaaaactaggccaaatcacaaggacgattgtcatatttaaacctttaatttttttgttaatcacttccaatcctaactaatttcctatatttttaaaataaacaaaccaatttattaacatgagtatcgatgagtttgtttgcaattttttttttgaagttacgaataaattgagattaattatgaaattttgctggcaattgatttttttatagtggtaaacgcaaaatggcgatatagggaatcagttagatttggaagtgataaatatgcaaaatcatgatataaagggaattagttaagcttggtatataaaccaaaaaataattatttttcaaaaaaggaatatgttagtttttttatagtggaagtagtggaaatattgagcattagttttaggcttggaagtggtgaactattttttttaattaagtatataaaatgaagggaatcagatgataaggagaagaaagaaacaaaatggcttttttaattgaaaaaaagaaagggaattagttttatgattggaagtgataaacaaaataaattatgtatatatatatatatatatatatatatatatatatatatatatatattaaatggaattgaataataaggagaagaaagaggaaattaattggcttttttatttggaaaatatatggaattagttttagactttgaaggataaacaaaaaaaataaaggtttgtttagtgtttcaccatatgactattagtaaattttattgctcgctattaaaggtttgttcgtttgtttaaaagtttcgttagttttttatttgtaaaataaccattaggccaataaaattaagaacattataagtttaattaattttttatgaaataaatttagaaaaactaattattcccacaggacaaccattttttctcatctcttatgtcatagatataggaaaacagtttatgttcatctcttttaatctcactaattcacatataaaaataaaatgaaaaatatgtaatataaacactatatttatattgatgttttaaaaatagtcatgtgttttcaaaattttatcatattaaaacataaaaatttacttacgcaaatataaacacataaaatctgcaacaagtgcagtgcaaatatttaaaggtgatttgaatataaaataaaatatatttaatagaaacactacattaatgccaatcttttttgttgaagaatttaatgttgatatgttgaaaatagtcataagttttcaaaactttctcatattgacacataaaaaatggctaccgcacatataagcacataaaatccgctacgggtgcggttgtaatatgtaacggtgttttgcaaataaaataaaaaatatttaatataaactcgacattaattttgatattttgaaaataacgacgagttttcaaaactttatcatgttggtacatacaatttacctctgtagatataaacacataagattggcaacgggcgcagtttaaatatgtaacagtgctttgcatataaaataacaaaatatatttaataaaagcactacattaatgttgattttttgaaaataatcatagttttaaaattttatcatatcgaatttctcataccaatacattttttatgcatttcatatcacttcataaaaatttgtttttgtagatatagttaaataaaatctacaatttgtgcatcgcaaatatttaccgaatttttgcatatatttttttaatagagacattacattaatggtgataattttcatttataaacatttcacaatattactaatgtaattattttttatatttatgcgagctgtgcgaatgaaggagtcttttacttgttatttgaaaaaatttaaaattatgtgaggggattatggggttgagttattttacacacaaaaaaaatacagaattggattaaaaccgaaaaccaaaacttaatctaccttcagataaaatacctacttgacatctcttatgtaccttaacattccttcttgattaacaaagtgaacttcaaaactttaattgaaagagttatcaacaacgtggaattatgataaagaatgttcaaacattaatcccagctaacctttattatctgcctataagaaaacaacaatgaacacaagacactcatacacttatttgtttattttgcaaatgtctgtttggtgaatgctgaactgttcaggatatatatctcgcatttcccatttcacatttggttcgttgctattcactatttttattttcattctagatttccaatggttattggtgcatgatcattcaatagcattattcttgatattgcaattgaagagataacaagtctatttggttcaatgggaaattgtagattaaatttttccacaattttagggagaaagtttagccacgttgaaatgtggttagctaatttgtcaagattttaacatctttggattctagaatccaaaccgaaaacaagtgttgccacacatttaaattttaggatccaaacatcttatttacatgcttcaaacctttcttgagtcaaaaataaatttcatatttttttcttaaatttttagcacaaaagaggttcgaagtatttagatgacgtgttcaaatctaaatatttgaatgactcggtttatatatgttttttttctctccataaattactagcatatgagagattcgaaacatgtaaaaagagtttatattataaaattcaaattattttcgaataacttttgttctattcatgtaaaatttctgaagaaagacaattagtcaccgtaaaaccgcagctaaaacaatcatgattatttgttttctctttgaaaatgacggaaaaacatatttcaaattttaaaataaaaaaaaattcagactgaattttgagtttctaaagagcgcacaaaaaggatgatgctataagaaattatgtacttatatagcccagtcaatgccgtgggatgcaatgtctgaattttattttatttcccaaatgaaagtggatagtacttgcaactttgtattgtttttcctttaatagttgagttgatgtaattaatgtgatggaacaattgaattgttcaactcatcgtaatgtttaagaaccacttggccactttttaaccaaaacttacgtggactttatgatattgtcaagtatatatatatagatggataaagctaactcaagctaatagacaatcattcaaatttcactcctttctagtttcaagctaattctttctgcttgctgcaaacatgtgtgagttcaatttctttcacttcaactcttttctttatttgtttcatataatgctcaaaagaagtaaaagcataactctgaattttttattttgtcataagttaatctataaacaaagctgaaattatgctgatttagatgtttctattaatataaatttgcagcaggaaaaaacccctatgctgttgctcagtatggttgtcttcttgtaaatcatgctgtaaagaaggtggtagatgaagttgatggaaataaatctgtatctgattggtttagcaaaggctatatgaaagttgaaagacaaaagaacaaactctattcaaatcgcgatcgtgtgcatgcaaaagttgaagcaattgatcctaaaactgaaaaggtcagagatgttgtgtttgagtggctaaaaaaaacagacataatcatacaagaagtggagaatcttgcagtacaatcaaaaccaccatcatggattgaatttaataatttgcaggaaaacattaaagcactaaataagaaatgtaattttgatccattttcaattataattccaagtttagaacacttctctttaggaaataattttgagtgtttcaagtcgacagagaaggcttcagatgaacttttggaagcactgcaagatgataattgtcgtataataggattgtacggtaggcgtgactctggtaaaactacattggtgagagtaatgggtgagaaagtcatgtttttaaatatttttgatgagattttatttgtcaatgtgaccaaaaacccaaatatcacagcaatgcaagatgaaattgctgactccttgaatataagatttgatagaaacagtgaagctgaaagagcaagaaaaatattatccacaatagaaaatatggatcatcctatacttgtgatctttgatgatgttcgggcaagatttgacctacgggatgtaggaattccttgtactagtaatctatgcaaggttcttttgaccgcacgtagccaaaaatattgtgacttaatgcattgtcaaagggagattttacttgattcattatctacagaggaagcttcgactttgtttgaaaaacattcaggcattctcgaagaggatcactcctcctcatttgacttattgaatgtggcacgtgaagttgcttttgaatgtgataggttaccaggaaaaatcattaaggaagggtcttccttaagaagtaaatcattggaagaatgggaaaaatcactagacaatttgagacattcaacggatcaatggcagatgttcctcagttttagagggggggatactcgctactcctttacaggtagtctttttcaagctttatcccaagggggattcaagattttcatggatgataaaggattgcacactggagaccgaatttcacattctcttcgaaatgcaattgaagcaacaagactttcaattattgttttgtctgaaaactatgcaaattccacatggtgtcttgatgaacttgtgaagattcttgaatgtaagaaatggaataatcaattagtttggccaatcttttacaaagtagagccatcagacataaggcatttgagaaaaggttatggcaaagacatggctcaacatgaaaaaaagtttggaatagactcggagagagtacaaaaatggaagtcagctttgcttgaagtttctaatttgtctggaatgacttacgagactggatatgaatatgaatttatccaaaagattgtggaagatgccaataatattaaaagtcgtttgcaaatacgaaacatatagaaaattgatttggttggcaatcgtttttggattttcgaatgatctaaaagttgttcttatgtcaaggatctaacggtggtccttattttggatgtaaatttgctttgttaattgtacagttttgcatttacagtctctcttgtaactttgtgactcaggtccttttaggctgttgtgatgtctcctccgatagaccggatcttgagtggtggtggaacctgaacgtttgaagtaaaatcactattgaggacctaattgatcactgttggcggtgttggtggtttttctttgaagggtttttggtgtttttattttttcattttggtgtaatattgggatttaatctccttatatatatataatatatattttgccattaaaaaaaaaaaaacaaagtctctcttgcaaccagattaaattgcctcttttttattacatgattgaattccctcttgtaagttaatagatttaccaaattatacatcgagaaagaatatattgacccttaatagagagactcatcatcattatcattcctatgcccaactcctgaaggcatgagtaccgtttacaatcctctgctgaccgtgatcgaaactggcttcacggaattctgaacattttgtttgtggatttatgtacctgtaaacaacaatgatgtaaggatccaatctttcattaaatttccattaaatcgggcttagagattaaaataaaggctaaactataaaaggcgtatcgaatgttcataagcatgaacatgaccagcaagaactaaatcaacactggcagcataaaggaatggctccatgactgtcatcatatcatcccctgcactttggtgtcataagttgtttcaacaaatttccataatctctccaagttagtttatgatagcagcttataacttatatgaaatacagtttggcttgttttatctttcgttaaagagataacttatgttctgttgccgtgagtttaactcagttgataaggacaatgcatgtttcaaatcttaaacaccacaaaaaaaagaaataacctatgaaatgtcaaatgtgccttttttttttttttttttttgcttttatgttttagtccatagctggagttggacatataatgttgtattttgttcttttgtttgtatcttgttactttgttcctcgactactcacatcttgtggtgttgaagctaataaaattattagccgattaaaaatgaaataaaatgttgttagttatgattgagtactttgatattgctaatcattgtcttacttatttttttcttctttccagccaacaaatttagaatcagcaagagatggtagaggttcatctgagtccaaaagaatgtctcattttaatgtgtaattttactatattaacgaagcgttaatgcttttttttctctctttcaattagtgcaatttctccctttcaatttcttctaatttatttttctactaacacagatgaatgataactttgtaaaatacactatacataaaatattgttcaaatatcatggttcctattcgatagcatataaatctcccaaatgtgaacatctatgtagctacaccgttgctttatggactagtttagtaaaaacttcaaaattgctttatggactagtttagtaaaaacttcaaaattttacaataaaaaaacctgaagtaaaaacgggttaaagttttgtaagtccaataggaattaagtttctagaatcaataattatagtttttttatttcccaaatgaaagtgatccgtaattgtctcacaacttgcaacttttttttattgctaattggatttgtattattcaattaagaacaacaattgggtttgggttgaattattcccatttataaaaaataaatacactttcatgaatcatcatgtaaatccctcaaaaaaaaaaaaaaaaaaagaagaatcatcatgtaataaaataagggtcttcttttcttggtctaaaataagggtctttaatgatattaaatttagaatattatttcaaaaaggtaaatattataaatttcacggggaaggagcagtggtggaaactgaaccaccaaaactaccgaaaacgaattcttgagaagcggaagaacgtgaaatttctgatgcggaagcttcaagatcttcttcttcatcaccattggaattgttgagattgtcttcaaatttgtggtctggaagaacagggaaatcgtgccacgattttggaatcgtgacacgattggaggtgccgtgagctagggttgcagggtgcaaattcgtgacacgatttgggaaaatcgtgacacgatcgtgaaacttgctcgttaagtatccttgataaggactggtcgttccttgggacggacgcaaatcgtgacacgattgggaaaatcgtgacacgattggaacagaggaagactagtacttaagtgttcttgtgcagatttgaagagagaggttggaagagagagacttgggaaatcaaaggggaagctctagggtttagggttctttgattagagtatctctcgggttgaaaacatgggaaacaccttgtagagagaatcattgagtgtcttggtgagattgggaaaggggtagaaattagggtttgttcatagtgaacttgtcaaactaatttcttgtaacctcttgtatcccttttgtaaagaactcatttgatagtggattggagagttcaaactctcctccagagtaggtcaagtttggaccgaactgggtgaacaatctctttgtgtttattgttttcttcttccctccttgtttatcttgtgattgttgctttgtgtttcacacttggttcctagattagatctaggtggtgttttgttgtttcttgcttgcacaataaactttgtttggtggttaccactctccgtcgctccacacatcattattctttgtattggtgtggttcgatccggccttggaggctcggggattcacaacaattggcgcccaccgtggggcaacggtagtgatttggtttagtgtgtaccatgggttcaaagtgagatattgagaagttcaccgggctcaacgattttgggttgtggaaggtgaagatgcaagcggtgttgattcaacaaaagtgtgagaaagctttgaagggtgaaggtgcgttgccggacaccatgtcacaagaggagaagaccgagatggtggacaaggcgaggagcgccattgtcttgtgcctcggggacaaagttttgagggatgtcgcgaaggaaccaaccgcggcatcgatatggtctaagttggaatcgttgtatatgaccaagtcgttggctcatagacaattccttaagcaacaactctactcattcaagatggtggagtcaaagaccgtgatggagcaattggcggagttcaacaagatcctcgacggtttggagaacattgaggtgcaacttgaggacgaagacaaggctatactcttgttgtgtgctctaccgagatcatttgaatcctttaaggataccatgctctatggcaaagaaggcactgtcaccttggaagaagttcaagcggctttaagaaccaaggagttgaccaagtccaaggacttgagagcggatgaaaacagtgaaggccttagtgtgtcaaaaggaaatggtggaggtagaggcagccgaggaagctcaaagagcggaaacaaggataagtataagtgttttaagtgtcacaagttgggacacttcaagagggattgtccggaggaagatgatagctccgcgcaagttgtgtccgaggagtatggagatgcgggtgctttgatggtgagttgttgggaggaaggtgaaggtgagggttctcaccttggagttgattccttgtagacggtatggttcgtctggagagacgttaaacactcaacgtcagcctggagaggcggtggtgagaatactcatggttagtttggagaggcggtgataacaatactcgtgatcaacctttgaggtggagtggcaaggcggaagcatagtggaagtacgcatttggaagttgaggcagagaaagctcaacttgaggtggagttggtaactccgggaatgttacggctatggaggctttgggagtttatgctctagtggtgagcatgtggattcttcatgaggacggaaggtattccggggtttgaagaatgtatggggtgacttgtgtgattgcctaaaagaccaagggtgatcggatgcaaggtgatcttcgaggaggcgggagacgttccgtagttgaagatggtttggtgaagacttgtggagcaacttggtgtagagttggatgcaagggaaaagaaaggggtggttgatggttaaagtggcatcatcaccaaattagaagtcaaggtggagaaatgttgagattgtcttcaaatttgtggtctgaaagaacagggaaatcgtgccacgattttggaatcgtgacacgattggaggtgccgtgagctagggttgcagggtgcaaattcgtgacacgatttgggaaaatcgtgacacgatcgtgaaacttgctcgttaagtatccttgataaggactggtcgttccttgggacggacgcaaatcgtgacacgattgggaaaatcgtgacacgattggaacagaggaagactagtacttaagtgttcttgtgcagatttgaagagagaggttggaagagagagacttgggaaatcaaaggggaagctctagggtttagggttctttgattagagtatctctcgggttgaaaacatgggaaacaccttgtagagagaatcattgagtgtcttggtgagattgggaaaggggtagaagttagggtttgttcatagtgaacttgtcaagctaatttcttgtaacctcttgtatcccttttgtaaagaactcatttgatagtggattggagagttcaaactctcctccagagtaggtcaagtttggaccgaactgggtgaacaatctctttgtgtttattgttttcttcttccctccttgtttatcttgtgattgttgctttgtgtttcacacttggttcctagattagatctaggtggtgttttgttgtttcttgcttgcacaataaactttgtttggtggttaccactctccgccgctccacacatcattattctttgtattggtgtggttcgatccggccttggaggctcggggattcacaacaggaatcatcttcgtcatcagaaactggatcaaaatcgctatctccatagcgctctgataccatgatatgaatcaaaggattacattgttctaggtcaaatgcaatggaaagataaattgtgtaattctctctaggaatcattactaagaaacaattgtaaaaaagataatgaaatagtatataggtgtagcttatttatagtgacttggagtacctaactccctaactaactttctacatagataacttactctccaagatatcttcttcactatactctaatatctactactaaactacaaaaaaatcgtactctaaatttttatttttttataactatcttcgattaaactcaaaatcttcttaatttttatgggtccaatcaccattttccaaaataaaaaaataacttatttattttttgaaaatttatttcatgggatgcaatgttagaattttttttattacctaaatgaaagtgatacgtacttgcaactttctattgtgattttttggtaatgctatttggatttgttattctaataataaacaactctgcattgtttgggttgacttctatagtatactataaaaaaatggtactccaccaaaattttataatcatcttcggttaaactcataatcttgttaattttatgggtccaatcgtcatttttcaatataataaactaacttatatattttttgaaaatttattttataagatgggatgcaatgtcaaaactttttttatttcccaaatgaatgtgatatgtacgatcccaacttgcaactttttattgtttaatgctacttggatttgttattcaaataaaaaataacccaaggaattgcttgggttgactttatttaaaaaattaaaattatgagaggggatgtggttgactttttttcacacgtgaaatgaccttctattttcttaatgcctctaattagatcacaaacctgcgttacataaacgaattgacttattttacacacatatatatgttgctaacttagaccaacctaaaaacattaaggactaagttagcaagtgtgtattttttatttagacaaaaacactcatttgttacttgtgtgaggaagcaagatagggccaccgacgatttttcaataacattatgatcgcaccaatgatcaacattaaaccattatctttttactttagtcttggatgtacttacataacatattcaagagctagcactgagatgtatgcttttatacagatcatgtaatcatacttgaagagttgagggaggaattgaacggaagattggagacatagagacaagccttaaaagcgtatagcttctacctaagacaaagtacatgaaatgtaatttcaacaaatgacaatatttctactttagaagtaaaagttggagatctaattatcatcccacaagttacacaatgtaaatactatgggtccatggtacaaatcgacgaagaaagagaaacatatgtaaatcattgaattcgagttgggtggttgaaaataaaatgtgcattgataataaaaagtcgtttgtccccgtgagcatagctcagagacatgcattattatatgcagcggctggggttcgaactccggacaccccacttattcaccttaaaaaaggtgaattctagccactaaactacttaataaaataaaaaatggttttgaatttttaccaaaataatataccagtttagaaattttcatatttgtggctttataatccagttcatgatttttttaggggaattcagttcgtaattttttttttttacgggattcggttcataagcataaaattagacaaaatttgtatttatatctataactatagtattaataagaggatacaataatgtcaaaataaaataaaaatgatgatgataaataatttttttttcaagtagtttaatggttagaatttcaccacttaaggtgaataagtgaaaaatacagagttcaaaactttcacatatataacataatatccctatcgactgagttatattcatgataataattccttttttaaaactataagaatcttaatattataaattatcaaataaaattttacaattgttttttatctataaaagtggaaagacagacatgttaatacatatatattgaagctagtttgaataataaaaatgcaaattaagttattgtcaacttgttattgtcaacatggtatttcctagcttccatatctttgatgaaaatccaacatgtatcattaatttaatttttaatgaaaagatataagttatttttcctaaaagaaaaacttagtatttgaattcaaatactaagttgatagggttcgaatcccggtcaccccaataaaaaaactgtatgcagctaatatatgcaaagtttctgaccaccacaaaaaagctaatactccctccgatcctttatacaagaaacaaaagacataaaacatcaagaccaaagatatacattgaaaatagtcatcttcatttaatacacttctacatttaaaaaataatccatgaatacccctaaattaattcctctttattccactaacttatttacttttaattttctctctcataataaataagggcacaaatgaaatttagcttcaaacatacttgaaacttggtcaatcttcttcttataaaaaggaccaaaaaaattctcacttttgtttctaataaaaaggaccggaggaagtacatttgaatcgtttaaaattgaacaatttagaatttaagcatttggtttgcttttaattctgaaattcaaaattaaaacctaaaatgttcaatcatgatcgaacgattctgatgtactcctagttaacaagtaacaacattgtactcacgtgctcccagctggacacgacaaactcaatccgtcaactaggcttgtttggtcattaaagaatggtactcctcgtagtacttatatatatataattcagctcatcataatgtatacaaagcacttagccactttttatatttaaaaccaaatggagtagtagttgatgtagttaatgcaagggaacaattgaattgttcaacttatcgtaatgtttaagaaccacttggccactttttaaccaaaacttacgttgaccttatgatattctcaagtatatatatagatgtataaagtaaactacgatctcaagcaaatagacaatcattcaaacttcactcctttttggtttcaacctaattctttctgcttgctgcaaatatgtgtgagttcaatttctttcacttaaactctcttctttatttgtttcatataatgctcaacaaaagtaaaatcataactctgaattttattttgtcataagttaatctataaacaaagctgaaactatgctgatttatatgtttctattaataaaattttgcagctggaagaaaaccctatgctgttgctcagtatggctgtcttcttgtaactcatgcggtaaagaagacggtagaggaagttgatggaaataaatgtgtatctgattggtttggcaaaggctatatgaaagttgaaagacaaaagaagaaactcatttcaaatcgtgatcgtgtgcgtgcacaagttgaagcaattgacagtaaaactgaaaaggttagagatgttgtgtttgagtggctaaaagaagcagaaatagtcatgcaaaaaatggagaatcttaaattacaatcaaaaccaccatcatggattgaatttaataaattgcaggaaaaaattacagcactaaataagaaatgtaattttgagccattttcaactacaattccaagtttagaacacttctctttaggaaataatttcgagtgtttcaagtcgacggagaaggcttcagatgaacttttggaggcactgcaagatgataattgttgtatgataggattgtacggtaggcgtgactctggtaaaactacgttggtgaaagtaatggaacagaaagtccaatatttgaatatttttgatgagattttatttgtcaatgtgaccaaaaacccaaatatcacagcaatgcaagatgaaattgctgactccttgaatataagatttgatagaaacagtgaagctggaagagcaagaagaatattatccacaatagaagatatggatcgtccaatacttgttatctttgatgatgttcgggcaaaatttgacctacgggatgtaggaattccttctaatagtaatcgatgcaaggtacttttgaccgcacgtcgccaaaaatattgtgacttagtttactgtcaaaggaagattctacttgatcccttatctacagaggaagcttcgacgttgtttgaaaaatattcaggcattctcgaagaggatcactcctcctcatttgacttattgaatgtggcacgtgaaattgcttttgaatgtgatgggttaccaggaaaaatcattaaggcagggtcttccgtaagaagtaaaccaatggaggaatgggaaaaatcactagacaatttgagacattcaactgctcaatgggagatgtttctcagttttagaggggaagatactcgctactcttttacaggtagtctttttcaagctttatcccaagggggattcaagactttcatggatgatgaaggactgcacactggggaccgagtttcaccttgtcttagaaatgcaattgaagcatcaagactttcgattattgttttgtctgaaaactatgcaaattccacatggtgtcttgatgaacttgtgaagattcttgaatgtaagaaatggaataatcaattagtttggccaatcttttacaaagtagagccatcagacataaggcatttgagaaatggttatggcaaagacatggctcaacatgaaaaaaaattcggaattgactcggagagagtacaaaaatggaagtcagcattgcttgaagtttctaatttgtccggaatgacttacacgactgggtatgaatatgaatttatccaaaagattgtagaagatgccaataatattaaaagtcgtttgcaaatacgaagcgtatagactatagatttgtcctagtgagatgccaataatcttatgtcaaggatctaacggtggtccttattttggatgtaaatttgctttgtaaattgtatatttttcctttatagtctctcttgtaactagattgaattgcctcttttattacaggattgaattacctcttgtaagttaacagatttaccaaattgtacattgagaaagaatatattgacccttaatagttatatggactcatcattatcattcctatgccaactccagaaggcatgagtagagttacaatcttcagctcaccgtgaccgaaaatggtttcacggaattctgaccactttggtcgtggatttatgtacctgtaaacaacaatgatgtaagaatacaggctgcgtgcataccaataaacaaccttaatagttatatggacagatttcagacagtaaccaattcagataacacatttttataatgtgtctggcagatattatttacctatgagctaagccttctcggtttccaccatcaccaatagttatctggacggcgccaccaggatccaatcttccattaaatttccattaaatcgtgcttagaaattaaaataaaggctaaactataaaaggtgtatcgaacgttcataagcatgaacatgaccagcaagaactaaatcaacactagcagcataaagcaattgttgttttgtctgaaaactttggatattcgacatggtgtcttgatgaacttgtcaatattatggagtgcaaaaagacccgtaatcaattagtttagccaatattttacaatatagaacaatcagatgtaagaaatgaaacaaaaagttatggtaaagccatggcagcacatgaagatagagttggaaagaaatgtgagaatgtgcaaaggtggagatcggctttgtcagaagtttgccttacttgaaggaagatttaagttcatgttacattgatgcattgtcaaataaggaactaatttgtcaattctctgcagaagaagcttaatttctactataagaatatgctgaacttgccatttgaggaatacttaattgatccgttaactatgataaaaactaattaaaataaattttaatgtttactgaccttccttttgcattggatctcatgagcgttttagttgtcacttttacaatctctactttcaacacttactaaagtggaatgacttttattttcaaccatcattgccctgatatattaaacaggtttaactctattattaattggtttctaagttacttgctacaaatttatttctacattgatctatacctgttacaagtgtttgctacaaatcataatgccttgctttatctggcaaatattaactatagaaaaattaaatgcataaacatcacttacaagctgttaatgtaaggttcagtattctcttaataccgaagtactaaattgacactagaaaaatgttataatctaatggtagaaacaatatcatttatgcaatgtacgtcataagcagtaattatggctgtcaattttttttgttgactaatttatctaagttagtcttaaaaaatcgaagttctctcaattgttagcgtctaatctatatgtttagcaaaatcaagaaccttcattcattcaacaaaagaagaatatagtggtcgttcgacactccgtctcttcaactgctgtcatcttatcaactgcagggtcatccctaagaattcggaggctcggctctgggaatgaaaagatgtcagtgataaaatcaattttttttttttttttaaagcaatgttctatttatattttttaaaagataaatataaggtgtcgtatatatgcggtacatccaaaggtgaaaatgactaccgtatttatgaggaacccccacctaacactaaaagcaagaggacctaattctaataggcctaaaaggctaaaacaaggggacagaaaatggctgggggtattaaaaacaattggatggcaatagtactagtgggtattaaaaaaaattgaggtccatgactgagggaggcccaggtctgttgagctgtttgcacccgctcagggccgggcctgtctacctctcttacagataatctggtttttctaatttcaatatgtaacatttttttgctggattcacaatttttagtccatagacaactttgcgacactttttacaacttcacaatttataaaaatctgacatttttttaatgttactggtaatacaaaaaatgttacaaaaatataaatatgtaacagtttttgaatgttactgtgttggaacaaaatgtgtttcacaatgaaccttattaagttttgatgataacaaggtattaaaaattgtcaattggttattactaataattgttcaattgtataggaccaaaggctactcaagttatttcaataggtcttggaagaacaatggaaagaaaaagaaattctgagcatctgaagaaaactgctcctgaagctgaagtgcttctgaagtgatgacgtcatcagaagcagaaagtcatcagaagcaaaagttttcatcagaagcaatatcgtcaccagaagctacgtttgatcctttaatcaaactgaagattcaaagtagctgattctcaatttagtcttatccaagaagaacgaagaattgaaagggaggtatcaacggatatatggatagcactaagcaattgtctctcgtaaatagagttgacaaagtacaagtgtacaaccactacctccactactctgttttctgtctacgctacaagacaaaacaacagccatgcctgcagaatttgtacgttcaagatgggaatgaatttgaagcttattcttcaaaggactacacccaaatcaggcaaaggatcactggtggataatcaaaggatttcaaacgactctttagacgtgctgattatctcaacgtctctttcacgcctctatataaaggagtgaagacttgaagattgaagatagagatacataagttcaaaagcgccaaaactctgtcaatttgattctacaaagcacactgaatttctgcactgatttgatacatcttagaaattcaaagtctagagtctttactgtattgtattgtgaacaccactgattgtatatcaagtgttcaactcaaactcaattctctgtatttttgtttgattagaagtctcttgcctgcgtgcttgagcattagaagtctcttgcttagtgcttgagcattggaagactcttgcgtgtgtgcttgagcatttttgtgaagtctcatacttagatagtattgagcatttgtaatctttgtgattatagtgaaatctccttggaagtgtaagggggactggactacttccgtgttgtggaaggaaccaggataactgcttgtgtctttgtctttcttttctctgctctgttcttttccgctgcaatctgactctgatcatttcatcagaagcaatcaaactgcttctgaagttttatcagaagaagtattttttaagagaaaaagaaaacacaattcaaccccccccccccccttcttgtgtttttcaccttcaattggtatcagagcttgctctgttatcacagcacttaaccgtgttacagtttaagatctattagaaaaacatgtctggagatgaggaatcagttactacaaaatacacaagtgtcaagcatgactatgatactgctgacaagaaaacagactctggaaaagctccaaagtttaatggagatccagaagagttttcatggtggaaaacaaatatgtacagctttatcatgggattggatgaagagttatgggacatactggaagatggagttgatgatctggatttggatgaagaaggagctgctatagacagaagaatacatactcctgctcagaagaagctttatacgaaacaccacaagataagaggaatcattgtggcttctatacctcgcaccgaatacatgaagatgagtgacaaatctactgcgaaggctatgtttgcttctctatgtgcaaactttgaaggcagcaagaaagtgaaagaggctaaagctttgatgctagttcatcagtatgaacttttcagaatgaaggatgatgagagtatagaagaaatgtactcaagatttcaaactttagtttctggattgcaaatactgaagaaaagctatgttgcttctgatcatgttagtaagattttgagaagcttaccttcaagatggagacccaaagtaactgctattgaggaagctaaggatctaaatactttaagtgttgaagatcttgttagctcactcaaagtgcatgaaatgagtttaaatgagcatgaaacctctaagaagagtaaatccattgctttaccatctaaaggaaagacctcaaaatcttccaaagcctacaaagccagtgaatctgaagaagaatcacctgatggagattctgatgaagatcaatctgtaaagatggctatgctgtccaacaagcttgagtatctggcaaggaagcagaagaaatttttgagcaagagaggtagctacaagaactccaagaaagaagatcagaagggatgcttcaattgtaagaagcctggtcatttcattgctgattgccctgatcttcagaaggagaagtttaaaggcaaatccaagaaatcaagcttcagctccagtaaattcagaaagcaaatcaaaaagagtttgatggcgacctgggaagatttggatagtgaatctggttctgataaagaagaagctgatgatgatgctaaggcagccatggggttagtggcaacagtatcatcagaagcagtatcagaagctgaatcagattcagaagatgaaaatgaggtatattccaaaattcctagacaagaacttgttgattctctaaaagaacttttatcactgtttgaacacagaaccaatgagttgacagatttaaaagaaaaatatgttgatttgatgaaacaacaaaagacaactctattggaactgaaagcttctgaagaagaactcaaagggtttaacctcatatcaacaacatatgaagatagactcaagattctttgtcagaagctacaagaaaaatgtgataaaggttcaggcaataaacatgagattgccttggatgattttattatggctggaatagacaaaaagcaaagttgcttctatgatctacagcacatacaagaacaaaggcaaagggattggatatactgaggagaaatccaaagaatacaatctcaagagctactgtgattgtatcaaggatggattgaaatccacctttgtgcctgaaggtacaaatgctgtaactgctgttcagtcaaaacctgaagcttctggttcacaggctaagatcacatcaaagctagaaaaccttaagttcaaggttatgacaaaatctgatcctaagagtcaaaagattaaaattctgaaaagatcagaacctgttcatcagaatctgattaaactagaatctaaaatcccaaaacaaaaggatcagaagaacaaagcagctactgcttctgagaaaacaatacccaaaggtgttaaacctaaagtattgaatgatcagaagccactcagcgttcaccctaaggtacaagggaggaaaagtaaaacctccaaaactaacccaaaaggacccatgaagatatgggtacctaaatctgaattggctaaaactgcaggtgtgcctaagggcaagagagaaacaaaggtcatggtacctagacaacggatgttcaaggcacatgactggagagaaagctttgttccttacccttacaatgaaagatggaggagaagtgaagtttggtggcaaccaaactggaaagatcattggtacaggtactattggtaattcctccatctcaattaataataatgtgtggctagtagatggtctgaagcataacctattgagcattagtcaattttgtgacaatgggtatgatgtaatgttcagtaagaccaactgcacactagtcaacaaggatgacaaatccattacattcaagggaaagagagttgagaatgtctataaaataaatttctctgatctggctgatcagaaggtagtttgccttctgtcaatgaatgataaaaaatgggtatggcataaaaggttgggacatgctaattggagattaatttctaaaattagcaagttacaactggtcaaaggattgcctaacattgattatcattcagatgcactttgtggtgcatgtcagaaagggaaaattgtgaaaaattctttcaaatctaaagacattgtatcaacctccagacccttagaattactccatattgatctttttggtccagttaacactgcatctttatatggaagtaaatatggattagtcattgttgatgattacagcagatggacttgggtaaaattcattaaaagtaaagactatgcatgtgaagtgtttagcagcttctgcactcaaatacaatctgaaaaagaattgaaaattttgaaagtcagaagtgatcatggtggagaatttgaaaatgagccatttgaacttttttgtgaaaaacatgggattctccatgaattttcttctcctagaactccacaacaaaatggggttgtagagagaaagaacagaaccttacaagaaatggccagaaccatgatccatgaaaacaacttagctaaacatttctgggcagaagcagttaatacttcatgttatattcaaaataggatctatatcagacctatgttggagaaaacagcatatgaactctttaaaggaagaagacccaatatctcttactttcatcagtttggatgtacttgttacatcttaaacactaaagactatctgaagaaatttgatgtcaaggctcaaagaggaatctttttaggttactctaaaaggtcaaaggcgtacagagtgtataattcagaaacacattgtgttgaagaatctatgcacgtaaaatttgatgatagagagcctggaagtaaaacttcagagcaaagtgaaagtaatgcaggtacaactgattctgaagatgcatcagaatctgatcaaccttctgattctaaaaagtatacagaagttgaatctagtccagaagctgaaatcactcaagaagctgagtctaattcagaagcagaacctagtccaatagtacagaatgaaagtgcttctgaggattttcaagataacactcagcaggttattcaacctaaattcaagcacaaatcttcacatcctgaggagctaatcattggaagcaaagatagtcctagaagaacaagatcatatttcagacaagaagagtcattaataggattgctttcaataattgagcctaaaactgttgaagaagctctctcagatgatggatggatattagctatgcaagaagagctaaatcaattccaaaggaatgatgtgtgggatctggtacccaaaccttttcagaagaacattattggaacaaaatgggtattcagaaacaagctgaatgaacaaggagaagtaaccagaaacaaagccagacttgttgctcaaggctacagtcaacaagaaggcattgattacactgaaacatttgctccagttgcaagattggaagcaatcaggttacttctatcctacgcaattaatcatggcataatattatatcaaatggatgttaaaagtgtctttcttaatggtgtcattgaagaagaagtgtatgttaaacaacctcctgggtttgaggatcttaagcatcctgaccatgtctataaacttaagaaatcactatatggcttgaaacaagctcccagagcttggtatgatagactaagtaatttcttaattaaaaatgattttgaaagaggacaagttgacacaacactcttcagaaggactcttaagaaagacattttgattgtacaaatatatgttgatgatataatatttggttctactaatgcatctctttgcaaagaattttctaagttaatgcaggatgaatttgaaatgagtatgatgggagaattgaagttctttcttggaattcaaatcaaccaaagtaaagaaggagtatatgttcatcaaacaaaatatacaaaggagcttctgaagaagttcaagctagaagattgtaaagtgatgaacactccaatgcatccaacctgcaccttaagcaaagaagatactggaacagtagtagaccagaagctatacagaggtatgattggttctctgttatacctcactgcatctagacctgatattttattcagtgtatgcttgtgtgcaagatttcaatcagatcctagagaatctcatttaactgcagttaagagaatcttcaggtatctgaaaggaacaactaatcttggactcctgtataggaaatccctagattataagttgattggattctgtgatgctgattatgctggtgacaggattgaaagaaaatcaaccagtggaaattgtcaattcctgggagagaatctgatatcctgggcaagcaaaacacaagcaactattgctatgtctacagcagaagcagaatacatttcagctgcaagttgttgcacacaactactttggatgaaacatcagttggaagactatcagattaatgctaacagtattcccatctattgtgataatactgctgctatttgtttgtcaaagaatccaattctacattcaagagccaagcatattgaaatcaaacaccattttatcagagactatgttcaaaaagggattttagatatacaattcattgatactgaacatcaatgggctgatatatttacaaaacctttatctgttgaaagatttgattttattaagaaaaatttgaacatgcattttgtgtctgattgaaaaattgcttgcctctgaataagaagtttggttctgaagtttattcagaagcatctggtccatcagaagttcttaactgaggttctgaggaaaatgtgcttctgaagatgacgtcagcactaaaacttcagaagtgatattctttgcttctgaatagcaaggttagtgggaacgttggcagttactttttgtaacagctgtctcattacccaaaaggtagttttctgaagagtctctgacgtggtctatttgtattggagtataacaaaaagggcaatgatgttttattcgctttttgacatactaacacgcgcccccaatttgtcattaatgttatgtttgtttgtctcttctgaattgcaaacgttttacttaaaaacactaagtcaattcacacactactcacttcacaacaaacactttctattttcttctcaaccctctgcgaaagtaagcgcattcactcttcctctcaaaacaccgtagaaccctaaaactccttcaaatcaatggaaagctcaagttctgctggtggttcatcatcaaatatggaaatagatattccggcttatgagattaaaggaagaaccatgtctattgaagaatgggagttaatcattcaagcagaaaatccagtggatttcgcctccttaactcaccatggatgcgacttagtaaagttctacaagaagcaaaagctgatgaattactttagtcttctcaatggtccaacatatgaagttctggtcagacaattctgggtaagggcttcagtctttgacattgatgctgctagacaggaagaagctcaactgattctggttgatcctactctgaaggggaaaaccaaagaagaaatgggtctactctccttcaccggtacagagattagatcaaatgtcatgggaattcctgtaaccataaatgagcaggttattgctcaagccatgggaagggatacctctggcaagtactttggagaagagattcctaatccaagaaccagctcttggaaggaaattgtcaatgagaccatttatgggtctaaggttgctcaaccttacagcactttgagcattgagaagaagttgctgctgaagattcaaaatgagaatatctttcccaaaggtggaggaagtgatcaaccgtcacttggtcacaaggtttttctgcatcacaccatcactcaagagaccacgatgaatgttcccaagtacatgttcaagtacatgatcaaggaactaaagaagagtcagatggaaaacagaaagtttgttccttatggaaggttgctctctgtaatctttcaagaaggaggaattctaagtgccttgaaggatgttggcatctatgataaccagaagctgggagcagtaactgggaagataatcaatgcatcaactcttgtgaagatgaaattgattccagcaaatgctcacaagaaactagattctgatatgcatgaatctgatgccatatctgatctagtcactcatcacatccctatctgcaagaaggatcccctggatgtgcaaagggcctacatcttggacttctacaaaacttacaagaagaagatcagcttgaaagatgtccctgaggagatgtatggtggtgatttgcctgtgacaaaaggcagaaagtcaaagaagaagcagatcaccaaggaagaatatcttgctgaagatgctactgagaagggtgctcagaagcatcagaaagctaagaaggaaaaatcaactttgtccactattcaagaggaagtggagaacttggatgaagtcccaatcatcagaaaaatgacaaggaatgctcaagaaacagcagaacagcttgcttctgaacaacctgcttctgaacaagctgcatctgaagagcctcagagtcctaagaagaaaagagaagctgctcttcaaaccatcaaaaggaagagatcttcaaggaatctgaagacagctgaaggacgaagggaagaaatgttggaagaactgcaagaaaactgggatgaagactcaagtcccaagaaggcaaaaaagactataacttctgagactatagtcatgcccagttttgaagcttctaaggaattaaagcaatatgctagggagtattctgcatccaagatagcataaaggaaaaggatgaaggaattgtatgagaagcaaagggatgagcgtctcaaggctgcagggtatgtgcctactcctgacattgctgctttagcatctgagttagagcaagaaacagttcagtatggagcaactctgctttcacaagccttgaagaataagcaagcttcaggagctacttcatcagaacaagtttcaaatgctccagaagcagttcatccagaagctcaatcttcaggtaattcatccaaacctgacatctatactcagattccttctctaccctcttcaccctcatcatcatcaactgaatcagatgaccaaccccttagtcaacacatagacaaacttctaaaaaccaaacctaccaaactaacagaatttggaacacttgactataagcaaactcaaatagaattttctaagaataggattaagctttgtgagaaattcaacttgcctgctactcatccactttatccagaaattccagaacctgttagtgtacaacaccctgaacccaaccaagaacctaaccaaacaaacccacaaaatgaccaaactccacaaagagcctctgaagtagtttcagaagcaactacttcagaaatcccccaacaacaagaatcctcaacccttcacaatctagaaaaacacttaggtggtgaaatgcaacctacacctacaaaggcctctaagacagtccctggaaagattgatttagaaaaccaacaaacagaaaccatccctgagcaaactgttcctgagcaaactgttcctgaacaagctgttcctgaacaagctgcttctgaacaagctgcttctgaacaagttgcttctgaccatcaaacaacagaaccacaacaacaaccagaaccaccaataattgacctaacctcttctgacaaacaaacagcctctgaccaaccctccacatctcatacaactcaatctgaaccttcaaccatccctgactctatccttgaatctgagtatatagatgaacagctaatcagacttagtgatgggattcagacactgattcttcgcagaacagttcatgtacctcctattcactatcttgatccgtggatggatctgaaaaagagttttgatgacctgctggatcagctaagttctaagtgcgtctcatctcattctgccatgctgcaaaagatgttggatgatatgcatgaagcagctagagtgaaagagctgaattttgtgcctctgctggacatcactcctttctatccagaagaagaatacattacaagggctgcaagaattcatgctgggtataaaagaagaatgagagaaaaggatgagctacttaagaagaaggatgagcaaattaagtatcttttggaacagatgtacaagcaagcccaaccctagttgcacaccaattttttttgcttgttttaatctttattctaagtactttagttgcattgcatttgtatcttaacttttctatatatatatatattatcattgtttctggatcttgtgcttttcaccttcaatgtattgtacaagctttaactctgatgatatttactgtttttaatgctgtgtactctgatataatgttttttttaaggttatatgtttattgctctgatactctttcttttgttttttattctttttgttgatgacaaaagggggagtaaatgtatagtattttaaggcactgagccccactataaccacttctaaacttttttaaatacttctgatattatttttatgagtattttattgaaatttaattaataagaatagaactcagggggagcttacaaacctcaccttaaagatctattagactcagggggagcttacaaacctctatcccagtggtcaacttattaattagatcaacaacaattgaacattttaaatattattgtttgtcatcatcaaaaagggggagattgttggaacaaaatgtgtttcacaatgaaccttattaagttttgatgataacaaggtattaaaaattgtcaattggttattactaataattgttcaagtgtacaggaccaaaggctactcaagttatttcaataggtcttggaagaacaatggaaagaaaaagaaattctgagcatctgaagaaaactgctcctgaagctgaagtgcttctgaagtgatgacgtcatcagaagcagaaagtcatcagaagcaaaagttttcatcagaagcaatatcgtcaccagaagctatgtttgatcctttaatcaaactgaagattcaaagtagctgattctcaattcagtcttatccaagaagaacgaagaattgaaagggaggtatcaacggatatatggatagcactgagcacttgtctctcgtaaatagagttgacaaagtacaagtgtacaaccactacctccactactctgttttctgtctacgctacaagacaaaacaacagtcatgcctgcagaatttgtacgttcaagatgggaatgaatttgaagcttattcttcaaaggactacacccaaatcaggcaaaggatcactggtggataatcaaaggatttcaaacgactctttagacgtgctgattatctcaacgtctctttcacgcctctatataaaggagtgaagacttgaagattgaagatagagatacataagttcaaaagcgccaaaactctgtcaatttgattctacaaagcacactgaatttctgcactgatttgatacatcttagaaattcaaagtctagagtctttactgtattgtattgtgaacaccactgattgtatatcaagtgttcaactcaaactcaattctctgtatttttgtttgattagaagtctcttgcctgcgtgcttgagcattagaagtctcttgcttagtgcttgagcattggaagactcttgcgtgtgtgcttgagcatttttgtgaagtctcatacttagatagtattgagcatttgtaatctttgtgattatagtgaaatctccttgaaagtgcaagggggactggactacttccgtgttgtggaaggaaccaggataactgcttgtgtctttgtctttcttttctctgctctgttcttttccgctgcaatctgactctgatcatttcatcagaagcaatcaaactgcttctgaagttttatcagaagaagtattttttaagagaaaaagaaaacacaattaaaccccccccccccccccccccttcttgtgtttttcaccttcatattggaatactataaaatgttgctgaagctttttagcaacacagactttacctaacaattgttcaaacgtaactaaatttaattagtaacatttttctttatttagtcacaatgttgtagtgattagaccctcctcctttgtacaaataaaagagacatgataaattaattaaagatgaagaacctgaattaatttgaaagtttaattacagagtataaataaatctaaaattgcaaatgaaggaataattgaaagtaaaactacatttgaagacaatgttctagagagagcttctctgccttcattctgaaaaccccaccactcgctcttaacaaactgccgtcaccaccaagctcttgttctcccacatcatccaaacactattcagcaagatgtagccacggtgttagtggtgcattttcctcaccgtcgtaccaccttaaaccccattgaagtgacaaataatccaaatctcgaagtagttggctcgcactaaatttaatgagctcctctatcaacattgtttttttttttttttttggagaacatgagagtttaagcccaaagcggaaaactaactcctaattaaacgaggtgtagaaacatcaatactattagctaaaaataattaactaactcgaacagaatattgctcatagataattaacacagattttaactatagtaatgattttaactcttttgtttccagtgagaaaaaactacaataatctaagtttggttgggatataaattaagagttcttatatttgaacacccttaaatttctaacactcatttaatacataattttctttttatctctttctcatatcacatcatcaataaaataaattatttgggtatatacgtaacgtgaacaaaaaaacaaagttatttgggtacgtatatcgatgattttccaaaagttaatcatggccacggcttgttcacccatgttttgagaagtgataaggaaatacgagtgaatctgcaaggaagttgggcaaaacagagaaggtcccgcttcaaggatgaatagattatttatttatttttgaccaagaacctacataatagatagattacttattttatgaataataataacacactatagttttaatattctgcttgtttcttatgatatatgatggcagctacattaatttgctggtaatcatgatcatgaacttgtcaccatccttgactttatgaagaccagaaaccaacttgtttggcctattttttacaaaatggaaccaacaaccataagacatctgaaaaatagttacgaaaaagctatggatgaacatgaagaaaaatttggaaaggactctgagaagctgaaagcatggagatcagctttgtttgaagtcgcaaacttaaaaggacggcacttgaaatatgggtacatagtataattacaattatatttttggctaatttgtgtgactcacacctatgctacgttttctatcactggttgtttgtcgagtagtcttgtgagtggactcacatatctgacgtgtgaaaaaatgatgaataggtttgaatccaactcttgcatatcaacgttcttgcaactactaattgagttgtatatattgaacttaacaacatgatttctatcttaccataagaacttgatctttaattactactatgtgtaaatatttattactcaaacttggttttattttgattgaataaattcagagtattattaggaagataatgaaacacttgtatggatgaatttaacggccttgaacttttgcaggtatgaatatgagcttatagaaaaaattgtggaaatggccattaaaatttgagctgcttgtagtaactattgtcaagtccttggtcgagtatatcaactagaaagaagatttggaagtttatcttgctatatagtgtcatgaatcaattcaacaaatgcgttgttttgtaagcatagcaccggttgagcaattgatgtttgatactggtaccagttgttgtaataattgaaagttgtgattgtgttggacgcttattatgcacttgcaataaaaaaatgtacttcaataaaataaaggtaatttttttatttttaatttttttggtcgagtaatggctagagtttcacacatattttaatgtattgttcatatcaactgaattatgtttatgaggacataatatatatatatatatatatatatatatatatatatatatatatatatatatatatatatatatatatatttatttatttatttctatagttgaattgaaaatcattttggcctgaagggacacgagatcctttaaaaggattattatttccgacaaaatcctaattctgatcctctattttttatattgtacaactttagtctcaattttgaccatccaatttaatgacgtgacaatatattagatgacttgaatgaaaacaaagggcatagttacccgtaaatctttaaaatggggtgtcttgagtcgtaatcaagcatacaatgcctagaatatcaattgaaatgatacaatgaattaagagtgaacaaaatattatcatgtcatcaaattggattgtcatattttttaaaatggaagagcagaattgtacaattaaaaatggggactaatatcatgtaaagcttattagctactgctattggagaagagtatttgttgttgggatgcaaggcttgcataaatgttgttccattgcattcaaataaaaagcttctttcatcgtatttcaaataaaaagttaatacatgaattcaacattaaaaatattagtatgagataaaattgtgggatctaatatgagttttttttaaagttcaccatttgagaaaaaattagtgagttgctcaacaatgatatggtataatggaggaatccgcaaaataacaattgtttgagatcatcattggaggtgctctaacaagatatatcactctcacataatgtttgaattttcgaatagccttgttagtgtgaactgaaaagtgtgtataatattagtgttgattagtattcaaacacataacatgtatatataatctaaaaattaaaaccgactagtcttaactctctaggtttataacacttttgtttatatattttttattttttttagtttcaaacatcacatcctactagacacaattaaagcctttcagtaattgaaagactagccataatcttatcctttggtcatggccatgttgaatgaaaaaggttgatggctgcagctacatgtacgatgtttttctatgttttagaggggaggacacttactgtacctttacaggtaatctctatcatggtttgagcaacaagagaatcaagaccttcttcttcccacatcaaattcaaaatgattataatgataatgagcaacttcaacattcacctattctcaaggcaattcgggagtcaaggatttcaattgttgttctctctgaaaacttcgcatcctccacacgttgtttagatgaacttgagaacatcattcggtgtaggaagatgtacggccagcttgtttggccaatcttttacaaagtatatccctcagaagtcaggcttctgagtggtaaggtttggtgaagccgtgctaaagttagaagaaaggtttagagattaccctcacagcaacaggttgcagcgatggaagcaagctttgtctgaagtcacagtcatttctggatggatttacgaaactgagtatgtactataatattctatactttcaaggttatgctcttttgaaaattagtcctgtgcttgaaaaactcgataaaaatttcaatagtgactgacatgttgccttttgaaagtagaagcttaaagttttcctcatccacatggctgagattgagaatttgactagcttgactgatgtcagttttgacttatgacaaattcaaggatagacaaatatatgtgcttcaaaactaaatttgtattcgctttttcatgattttaccaaacagacatcgatcatatcacagtcggtagtaaggcgagaggactctagacttgtaaacttttacttctaaggaccaactattagcagatccaccttgttttgttaggctttagaactcttatattgtttatgtttgctaatatgcttgaatacaagaatagtccatggtgtatcatctcaatcataagagtttgactcttatattgtttattcctcgagagacggttgtaaaacgttaatcggtgtcactttaattaataataatttttctcttccccaatttttttaaaaggatttgttcattcacaggtatgagtaccaattcatccaaaagattgtggaattggctgtccaatcgctaccatgctatgatgtttttctcagtttttgcggggaagatactcgctactcctttacaggatttctctaccatgctttgagtaatgagggattcaagatcttcatggatgatgagggattggagggtggaaaccaaatttcacaaactcttctcgaagcaattgaaaaatcaaggctttcaattgttgttttgtctgaaaactttggatattccacgtggtgtcttgatgaactagacaagattatcaagtgcatgaagaccaagaatcaattggtttggcctattttttacaaaatagaacaatcagatgtaagcaatcaaacaaaaagttatggcaaagccatgacagcacatgaagatagatttggaaagcagtctgagaatgtaccatctactagttgttttaataattcaaaattgtgttggacgtgtatcatgtacttgggatacatgcaatttctaatcggtaaataacacatcaataccttctagtttgtaattaaacattgatctctctttttttttttttattcaaaatcatatacaactcccttccacttaacaccaccgttggttagttctcggttatacaaagaagttaaagctcgccaaaaaaatgataaattcaatggcggaaaaattcaagtcataatgtagacgggggcgtgcttcaatgcggctgcgtgcacggggactgacgtgttccctcatgtcacaatgcctcattcagggtctacgtgccttcatatgatggactttctagcggtccagaacaatatataagatttaaaataagataatgttgggagttatgtttagaataattttagaatactggtttagaatgagacttttccatttaattattatatattgcatcgatttccagcaattgtttcacaacttgaaatttttttcattgctaattgaatttgttattctaatcaagaacaacttgacttgttaggattgggttgatttattcccataaattaataaatatactttcatgaatcattcatcattgcgtacctaaaattatagtttgtcattttcatcatataataattataaaggaaagaaagaccttgaccaaaaaaaaataaaaaggaaagaaagacaaaagagggttctaggacaaaccgcatgaattcatggcattttgttgcttaattttagatgtttgtgacatattgtacattgtcaatgttagaatttttttcatagcctcattagtatcgattagtgttcaaactaattagtctcaactcttctatgcttttgcaacatcagatcctacaagacactatagttatgttcattcagtaattcaaagactaaagaaaaacatgatgaataaaaatcaggttgatggcagctacaagtacgatgtttttttatgttttagaaaggtggacacttactataccttcacaggtagtctctatcatgctctgcgtaacaagagaatcaagaccttctacccacatgaaactgatattaagaaacttcaaccttctcctattgtgctcaaggcaattaaggaagcaaggatttctattgttgttctctgaaaacttcgcatcctccacgcgttgtctagatgaacttgttaacatccttgagtgtatgaagatgaaaaatcaacttgtttggccaattttttttaaagtggagccttgggaggtaaggaatcagaaaggccgttttggcgaagccatgttgaagttagaaaaatggcttcaaaattatccttacaggatactgcaatggaagaaagctttgcatcaagtctccttgattgctggatggaattacggtgctgagtatgtactacttttctatataccactagtagcaacctagtactagggttgttccaaaaaaaaacaaaaactgaacagaagtgctaaaccaaaccaaaccgcatcggaaaaaagcaaactgtgactaacagtttttgaactgaactgaaccagtgagacattgatgtgattcagtttggtttagcgtttcggtttttagtttttttaaacattcataatattgacttggttcgttttttttcctacagttctagttatgagttaatgatagcactttggtatcattcggtttgaaaacgtacattaaaatttttataaaggtagttttggttcggtttataactacaaaacagttgtaccgaacctctataataaaagttcgttcaagacaaatcaataattgtttaattctttttttctgagctgtagaaacagttcaattaaattaaattcagttttcttttggaactccaacggtcatagacatcaccttttggaagtagaagctcacatttctcctcgtcttcactgttaaaatgatcatttgaccaatgatggattgacaaaaataagataaaaagaatattcatgtctggaaactcatcgaacatacacaattcaggtctcaaccataaggaccgtgagattctgcatccgatgagcgtcattcgagtgattttttaagtatcgatccaccgtaaaccaactatcaatagaacccgtgttgtttgttgggctttagaaatcttgtttgagactttgtttcaggttgtcaatatgctcgaacacaataatagactttatgaattaaaatgatctgtgcattcataggttcgaatatgaactcttcaagaagattgtggagtcaacggtacaatcactgcctcgctacgatgtttttctcagtttttgcggggaagatactcgctactcttttacaggatttctctatcatgatttgcgtcatgagggattcaaaatcttcatggatgatgagggattgaagggtggaaaccaaatttcacaaactttactcaaagcaattgaaaaatcaaggctttcaattgttgttttgtctgaaaactttggatattccacatggtgtcttgatgaacttgtcaagattatggagtgcaagaagaccaataatcaattggaattgaccaatattttacaaaatagaacgaccagatgtaagcaatcaaacaaaaagttatggtaaagccatggcagctcatgaggatagatttggaaaggaatgtgagaatgtgcaaaaatggaaatcagctttgtcagaagttgccttactgaaagcagaccatatcaaagaaaatgagtacgtactagtgaatactatagattacttttagattgcattaacgttggctaatcccttaaatcagaaactgctcttgccatagacaaattaaagttgtagagcttttgtaggtacgagtatgaattcataaagaagatagtggaaagggccattgaagctgaaaatcacatgtgataccaataagtccatgcagaaatgacagagaaggaaggtttgagttcctcttacattcaagcatcatcaaatcaagatctaggaacacttgtgcagaagaaggtgaagtcacttatatttactgtatatgtggttgcttgatgcctactaaaagaatatgctaaacaagaattgccaaaggtccctacaacttgattgttgatcaatttggttgtgcaatttcttttagtggtagagcaggatcgaataattacaggggcaagaggcaattatatttctatcgagttggacagtgtttaaaaagacctgtcaaaactataatgctggcaagaaagtgttaagagaagtttatatacataaacatcaacttacccttaaatatgagtcagtattcttttaatgttagaaacaatatatttgcatccattgtatcaaaataaatctttacatttccaaggactgtccattgttaattatgactcttctaaaggttgtgtttatttcttaaccatgtttgattaaattagcacttgatagttgactcactataagaaaaaaagtgacagaaaaaacctgaggtgtttgtttacatgtacaaagtcataaccttgtaaaattcaatacggtaacaactgatgaaaagattcataaaatatagggtttttgatccactataaacagccccagactagattctctataaaaactaaagcattcctcaaatgtgcttacaatatgccagctactatttttctgcatataatgaatcaaaggaataaagcaataaatacacaagacaaaatgagcaaatttttgctctcctccgaaagatgaggaatttggaagggagatcatatttgtttcatattttaacttgaataacctgatctgatctaaatctaatctaaatctaagggggtgtattggattgagatttcaatggattttaaaagacttttttgttttataaaagtcttgtggtattcaatcaagatttttaaggaatgtaaaacattcttgtggtattcaattaggattttcatgattttttaatgagtccaatgaaatctagtggtattcaattgagattttgcataacttaaaaattgtctactcgtattcaaaactctacggattttaatggattgttgtgagtaatggattttgtgagattgtttagtgtaaaatgtacctactaacaatctcacacctagacttgagacttttctatctcccacacatagccttgaaattttgtaatacttttccaaattcttttttttttttttttttttacgtttcttccaaattcttttctattctactgtaacaatgacaggttatatattttgtttggcaaacttattgtcgaaatcatcatgcctctaacttgcacttttcttaacataacttttacgttcattaaaaaaaagaatgtactgtataatcttgtggttaatttaccatctacctatatatcaaattattataaaaatcacaactttacgttcattggtattataataatttttctacttgcatttttcaatcaaattattatatctgtacttttgtttttgagagattttttggtctgtactgtatctttaaatttattgacccttttaaaatctttaaaattcattaaaatcctttaaaatctatatcatgaatccattaaaatcttgcaaagaatcttgattgtaaaaagtctttcaaaaaaagtcttttaaaatcccacaaaatcaatacaatccaacaaagtcttttaaaatcttcaagatttttttctatcaaaacagtcttttaaaatctcaatccaatacaccccctaaatctaaatattataatgatgaaaataataattttatactttccttccattgaaatcactactctcccttcaaggaaacacatgattttaaaatctcgccccctcctgtctattctttttttgaaacggccaatgttattaagcaatacccgtgcaagaatgatcgtgcaccaacaaccatagaaaaaatataatgcaaataaaaatctaggacgcagggagccaaaagttaggtgggcccaacccacgatttagaactgaaagttttggcccaacataaacaaataaatgtttagatagaaaagtgagtgtggaaacgtattgcaattgcaaagaaattaggtcaaagagtggagaagatggaggaagggtggtggcgttctgttgttgtgaatgttcgtcaacaacatgtttgtcagctgcgtactttctttcatttggagcagatcagcgttttgaacaattttggtaccgttcgtaaagctaagataatcaaatacgacattgatgaaggtttttctttctgtttccgtttaacatcttatgcttgggattttgtggaacttattgagaaaatacttcctgtgtcaagtttgattgggatatgattcttcctgaaagtgaaatatacctttttcgtgttaaacaattgtttgtattataatattaccttttatacacggattcattcctgtgctggattgaaatattttgtggatctgttacattgttttttataaatatataaataaatagttcactctatttgttcttgagttctgattaatctactaagtatcgtaagaagcaaaactggcaaaccatctttattaggagattaatctactactctatttaactttacataaatagttgaaagtatagtgtggctgcttctcatacatgtcctttctttcatttgctgaagcatggcggtgccaactgctactgttgtgtgaatcaaattgaggtattttataaaggaactagttcctggctactaagaatctctttaaaagataagcaacttgttttttcttgtgatacatttgtccatcaattatgagattgctgattacaattatatgatattctgaggtgttcagttatatcaatatcattataggctattgaagttgttgcaacttacaacatgagcttgaaaattattgtcttaaacccctctcaggtttaaatctcaaagccttagggatgtagattttgcagcaaaactggtttatacaactcttgcattcaaacatggctagtttcgcttctcttcacttggaattagtagactagagtggcacccaagctatattaaagtgtgatatttgcatcttcaccatgcttctgtaaaagtctatgcagaaaactcttccctaggcagcttggcgccagtgtgatcgtatatctctccaatactggtttttgaccttcattatgcggttaacaattacgcaactaatgtgcattcattggtttgattttcttgtatgtaagtctcagttttataaacctaaaacagttggtatggtattatatttttttctgcgttcatctgggtgtttgactcaaatattttgtggatttgttatatgattgtagatatagtttattcagagcaagccatctattggacatttggactctggttctgattaatccattatgttagtaataagaaaaactagcaacccatttattaggagatttccaactacataaatagttgaaaatatattgtggctggttggtatttggggcttattcttactggaaactttgctcaaggctaagttatcgaaaaaacaagatcccttcctttatatttagaatgtagttttggttaacaatgcttatcaaggctgggttcatacacgtcatagtatgtccacaaaatccagtcagtggagctcagggtaacaaatcgggttccatgccatggtttcgttacattaacacccttacgtgagtcatatctgatttaaggtgttgtttaaacatgctgggaaatttttgttgtgtgaaaaaatattttactgaaaagtactatgaaattaaatcccatttatgagaaaacaaaaatgtgacacctctagtttgagagagggatagggaaagggaagtacaaacatgccaagtttgagaggcatttttaattttattgattgtgtaatgagaaaacaaaattcattttgataagttactagtgggcatgcatctggtcacatgatacgacgacacaacacatgaaaccactgatggttcgacctacttgtcatcaaacatatttcatggggggtcatttgaagaagagagcagccaacgattaaatattaccctaaacctaagaatgtactataaaatataaaccataataagtgccttcttagcagaacatgcaaacctgaggtgggttgataataggggtactaaaaagactgccgtaaacaccaccatttgatattgtaagagtgcctccagccatctcatcaattgatatagttccagcattagccttctttgcagagttcattttatccgcattacggataaccagcacagcaagtccctcggtaggcaagcaaaaaatgcaaacatatacttaattagcttaactcctttaacccaaccattaaacattttcaaaccagtcatgacaacatcaatcgacataggtcaatgacatgggttaagtttcaccaaaagtataataaacccaacactatggatttttctacacaataagaacagtagtaaataagtgaaggttgaggtgactgatgaaaaccttcggagttcccacagctatgctgatgtcaatataatctctgtatataatatcatccccatcaatgaccgcatttacaatcagttgatattgaaagggcgttgacagcagtttcaaatttcaatacaccttgtgcctggtttgtgttatattatgttgattttaaaaataaaaaataaaacaagaaaagattaatcataatcgtattgatattgcaagtagctcataaaattttccaaatgtaagctatattttccaaagagtaagttacttctaaattaagtttcttagctttttataatgaaattaaaaaaaagcgaatatttttaatcttaatttactttttatatagaaaaaatattttaaaataccttcttaattaaagtttatttgtttacttttcaattaagttatggccaaatgataataccttcatcaaaatattttttttatcgatctgcctgatccctctaccacttataatattgattttcttatatagaaaaatatttgaaaataccttctcaattaagtttgtcctgttacttctaaattaagtatactcgggaaacaccatctttaaatatcttcatcaaatatttttttttttttttatataaattaaatccaaatcctaataaacaactcaaaaaaataataatcccaattaacaatcctattttgcgtttgagatcgcttaatctcatttgcatccgctttaatattccaatttgcaaatggggagaagtcagtcccatatacgtgacgatcttttcaactctattctcccaaaattacctatcaaatctttgaagaggtttggatgtgtatgcaaatcatgatcgcttttatttgataattcatatttcatgactatgtatcgcaataatctcttaacaagagaacatccttattatcatgatgtgtctgttctactacatcaaacatttactccttttgatggttattatctagatggccaagtgtcaacttagatcctatataactatatcaatagtgtatatatatatagtaagattttttatgccacatgtcccttccacgtttattctcaatatttatattatttttttattttttaaaaccaatattttatttgacataaatatctcaacaaacttttgatcttatccactcaatattttatttaattttttattaaatttctaatattttatgtagcataaatatctcaacaaactacgtataatacttttaacaaagtttacatatatgatctttttaatgattaaaaggctccaattattttttttaggaaaagaaacttcaattaattactaactaatcttttagcattgtatcattcaattaatttttctttttgaagaaaaaaggtttcgacttgctatatggtgcgaaaacattaaagcacgacataggcacaataaaagccaaacaatgctttaatattttttaaataaataaaagtagaacatggtcagcagcaaaatgaggcgaaaattaataaggggatcatattgaaaactcataattagttaagagaccatttgtataatcaagcctaaaaaaagcacgtggttaaatgaggtggtcttaggacctgtttggattgagcttacgtaaataattaaacttttatcttaattcataagatcttacaaacaaaaattgtatattcttaagttgttttttcatgaactaccttaacaaacttataaataatacattaatgtttagttatttgcataagttgttttgcataagctctataataaatcaatccaaacagatctttagtgttgaattataaaatgggtttgttacattttaattaagagttttacactaaaagttcatgaatgagctaagctggtaaaactcttgcaagatgacatgcttttttcattagactcaaccatgtacaccatgattttttttttcaatttcttagaactttcttagaattagagtgtctagtactggaaggggccagtagcttccttgaggatctacttcgtaacatcttaaacagcatgagtgtcatcctatacaacccgacaagatgccaagtctctaatacgcccgatcgtgggatcaagtatgttggtagacctctatgatcttctctcgctgcatctgcaagggccacttcttcttcaattgccctctacaactttccttcgtgtaaggatgttatatctagaaataccatcacatatatccaaataatgtgtctcatggatggctaggaatataatctaaatattgagctagcatgctccaagtttactatagaatggatacaattagatgccacgatcgagagagatagtctgcatgtatctaaactggggaggataacataccatctaacgagcatcgcgtttgatccatcctaaatagaaccaattggcatgtaaggatgtatgtggcatacatacccctcctagttagaacaaattaactagcacgaggatcctcccatcgtatctaatctatcatattcctagccacttaccacgaaaatgctacaagatccatgccttcatcaaatatacaaacatcatcagagtggatgaaatgatgttatatatttttaacaaggtaattaggtaaacattcccccatttacaatcattaatcatgtgcatatccttcaagtactttatgtatgccacatcaacgtaaatgtcactagagataggaataggtcaggccgacctacaagggcctacgacctagcctacgacaggtcagatcaggccaaacttttttcttaaatagagaaagtttgggcttttttagaagcctatttaacttaaaaggtcaggccgtagaccattcaaaaagcttcttaggcttattaactggcttatttaagtaaatttaataatattattgattattatattatattttatactttaaaataaaataaaaatttattaacttttacagtaatttaagcttattagcatacattattttattttttgcatattttaaagtattattataaactagaattaaaatatgatacaatatttagttaaattatttaaaaactcatgttgattatataaagcgagtttttatctaattgatatattagttcactagtctatttaaacttcgatcacattgcttatttaaagatgttcatatgaaataggcttttaaacaggttagcagaccgtatcaggctttcagaatgtcagattcatgcctaaaaagtaaacctatgaaaggccacaagtcagacttagggctcaaaaaaatttgacaggtcaggcttaggccttgcaaaacctagctcggcctaacctactcccatccctgcatgtcacttttattggagaaaatgttgaagcgaatctagtggcgaggtttgtcaatctagtgtcaacaatgacatttgtgaaccacctttcttctacggtcgtcgatcttttttccattactaaagcacttcaatgtttcatgcaactaaactacccatttaacatcttttgcttggcattttgtgaaacttataggggaaatacttcctgtcaggtttgattgggatatgattcctcctgaaagtgaaagatacctttttcgtgttgaaatcgtccccatttgctgcggggatttgatctttctgcctcctaatgttgttgcttctttcggtgaaaatattggtcctattgtcatttgcactagggttgccaaaacatttactttgcttgatccatttaccttgacccactgtttcttagatgctcatcagtactggaaagcaccattcacacattcattcaataggactcagttagtcgaatatgttgttctcgatactgtcctcctccaggataaccaagatgaagaagaagaggaggataaggagaaaaagaagaattatgatgctgatgctgttgctgctgccaaaaaatattgtttagctgatgctgtggttgctcgtgtgaaagatattggaaataatgacacaacttttcaaatcaggactcatcttggtcgtattttaaaacccggtgaccatgctcttggttatgacctgtctggaggagaaggaggagctgacaccaacatcaatatcaaccttcctgctgccattttgatcaccaagattagttatgccgaagagaatggtagagttgttgctcttcatgataagtgggaatctgattatcaactcttcttcaatgatctacaacaagacactaaactcctcttcaacgtaagagcagcctaccgagatcaaaccaaaagctacacatatgatgggcccttcgtaatcccccctaccagaccttttgttccattggaggacttgcttgacggatgatctagttactagcttaaacaaaaatcacttttgttaatgttttgtttgttccaataacaacaaaaatcaaggaagatgcttttcatttattaggttctttctatttgcaatttttgtttcatgtttatgtttattccaatgacaagaacaagtgcttttcacttaggttgctgcagtttgcaatttctgtttgatatttatgtttattccgattacaagaacaagttacgtgtgttgatcgtgcttcacaaaccatgcctgtcattatattcggcataaaaagttcctttcaccatttcatgtcttccatgtggtacactagaaagcttacagatacaattaagcagctaatatgcattggttcgatcttctctgctacgtaaatatctgtttcataaatctttaacagttatttgtagtatcgtattaccttttatattgattaattcctgtgctgaattgaaatattttgtggatctgttatatagttataaatagtttactctttttggacttgagctttgattaatctattacatacactaagaagtaaaactagcaaaccatctttattaggagattccacctacataaatattttttttttaaaagaactacattaattgttgaaagttcagtgttgctgcttctaatatgcgtcctttctttcattcgctgaagcatggtggtggcaactgcttctgttgtgagaatcaaacggacggatcaaggtattgacttctttttctgtagttaaagtcatgctcaaaagtagtttgtgcattgtataaaggaactagttcttggcaacttgtttctcatgatacatttgtccatcaattatgagattgctgaatttgctgattgcaattatacgacattttgaggtgttattataggctacggaatttgttacaccttgagcttgaaaactattttgtctcaaagccattcgcaatctcattcttaagtatataatcgtgtctcaaagccttagggatgtagcaaaactggtttatataactcttgcactcaaatatggctagttttacttcttttcacttagaattagtagctagagtggccaaactgtattaatctgtgatattaatttacagcttcaccatgctgctgtgaaagtctgttatgcaggaaactcttccctaggcagcttggcaccaatgtgatcatatatctctatttttgtttcacaacttgcaaaggctgcattaggtgatgatttaccgtggaatctgcaaactcttcgaaaaatctaatactggttttttaccttaattatgcagttaacagttcagcaactaatgtgcattggtttgattttcttgtatgtaatgtaagtctcagttttattataaatctaaaacagttcatacagtgttacatttttttttttctttctgaattcatctgcaagttggattcatttagtgttggcaaagctatgggaagtcatgaaccctctaaagttatcatattctcttggcaaatattactctgccactaccaacaaaagaaaattttactaagcgaggagtttttgagggaggggatgagtcgatgtgtgagtgatgtccaagagaaagggaatcaaaagaccgcttgtttatcaaatattatttcacgagtgccatttggtatgagagtttttgataataatagtttttgaaataagacttttccttgaacaagagtttagagactacttgtgtatctctataggttagagactaaatttatgagagaatgatagtttagtgattgattgtttattctaaagttttgtttgtcggtttcatgtacttttgtaattttgtgtcacaatatgttcttgtgcatgtagatcgctgatattagtttctttataacattacttgatagtgaagtaacaacaattttgatcaaaagtaacagagctcaagttgatgaattataagtaataattcatgtttaatttgattaaaatattgtggattcaacaatacaattgtagcctcctcaatacgatgtttttctcaatttttgttgagaagatacatgctactccttaatggggaattctctatcatgctttgggcggtgagggattcaagatcttattggataacaagagattgaaaagtgagtctcttctcaaagcaaattgaaaaaccaagcttatgaccaaaactatggatattcttcattttttttcaagtttatgaccaaaatgcttcacttttcaaattatttgtctataaattgttaaatcaggcttcatgcaactgagttcatttcagttcgacaaaactacacttattaaaagcagagacgaaccccgtggaattgagtaaactagccacaaattaagtaaatttccattcttgactggtttggaaagaattggaatttgactgagctaattaattaaactaaaatacatgtgcttagatatctcgatggccattagtttatgaaaagctaaacatgagaaacagggatgaagtagaaacagaaccttataaattgagtttttaacattttataatctggtgtgaaattagagaattgccaaatctgaaccatgtaatagattgaatggttgggatttcttcaactgcgtcctctcgctttcataactcaatattttctaccttcactcaattttggagacttttttgttgatgtagctatgaaatggttgtacagattgattattgagtgtcgtttaatgatgatgccatatcataaaaaataaaaaaattccaaaattgagtggggtagaaattgttgaacgttataaaatagggaacctaaaataattggaataataaaaaaaccaacccaaaaaaatcaaaacatcttttttttggtacaacagaggagcaaaagccctattaaccatcttaattattattaaaaatgacacaaaattgaccaattcattcacaaattgttactgcatccgattattgggataagataactatagagaaaaatcaatgcgagaatgaaactcagaaaacggatctaagatgtcgaataagggaatgaataattaatgttgtttaaaatgaagtgcttttgacattaagaaccaatttgcagccaaaatagaaatacttttgaactagatccaagtacaaattttcactaaaaccgtcatcgcagtcccagttacattcatcaacaggtcctcaaccaaaactcaaaaactgtaaaaatcaaaattgcaaccagccccaaatagccggtagtaactaatctagaccactgacttttttaataataaatctaatggttaaacataatataatttgcttaccattgaatggctattgttcattgaacttctgcaataagttcaaacttccctccatttctcacatttttgcagtgattaaacgtcatatatgtgtattatgtatcctatgcttgcatcagtgcatggattgtaacaacttcaaagccaactcttcttgatcttccgtttgtcttcttgaagcttcttttctttgaccctcatcactgtcactgtcaaagtatattttactctttttatgacgtctatttatcggttcgtctccttctgacccagaggtatcatcttggttgtcctcttcttcctcattaccagccttccatttcattttctgcttaaattttttatctctaagtcgctgacgctccacaagtttatcttccttgtctgccttcttcaaatcctctcgcatccttttatagtattcagctttttgttctgcatgaagatgagatacttagatgccaaaataaacaacatattgcatgcttaatcaatgataacatataaacaaatacagagtcacaaaatattgtaaacagatcgggtctggccacgattaggttcttgaagacttgaactcaacaatgatcacatacaatgtaatagcaaatacgaaagcgatcagggatatcatactaccatatataggaattatattatatctcggactctataaggaactaatgcctgtctaactgtgctattatacaaaggcaaatgtccttattcttcacttgtgcatttaagttaaagttttaaagcaatttttatcaatttatataaggaaagaaatgaagctaagatgctagtttaccataactgaatccttgtcaaatttggcctcccgaatgaaacaccataacaattaacatttaagttacatattgaagttctgaataagcttgaaaaagaaaaaaaaataaattggaaaggaagaaaatttggcattcacgtgcatcaaaattttagataatgcaatcaatagctttacacatatacagacaaggattacattttataaaatggtttttactattcaagatttggcttcaagtgcacatacctggatcaatcaatgttccattgccactttgtgggtcagcaatcctggctagtggaggaagtgtgttgccttcatcgtcgaatacaacccgactccccagtggtctatgcgtgttaatcttgagcttttttttctttaataaacgagttgctggcctgcacgtgaaaaatctaaatcagtaaaaaaagaaagtagaaactcaaagctccacgccaaatgatttccaacaagaaatgtcataaatcctgcttcataaatagtactgatttagaatttttcacaagtcatcataagattttataaagaatctccaattgtctcagcaatttgaaactgcaagacttgtctgccccatttgaaaattattataaaataccaaagcaagagttcagaacaattaagtaaacttctttcactaaactactgaacaaacataaaaagggacgtacattaactctccaatttcagctgacttcacgtcgccttcatttgaggtatcagccacatgaagaagatcgttttcaatttcctcgtctttgaaaacaattgtgtctatcttttttcttgaaccttcaaaaacattttccttttttggaacctcaggttcaactaaaattgattttgttgccacagctttagatttaattttctggtttagaaaacggattttgggggtcattggcagacctaatgatgctgaatactcatcaataggaagtttcaaaacatcaaagatctctttatctttttggaggtggatggatctcaagtatgtgacaaatgccctttgggcccgctgctgaagttctgggtacttgaccagtaaagatgcaagcaaactggacactggttgcagcagttctttccttggctgaataatcgacaaataaggcacagtaagcaaagcaaatatgtcagaaaacatgagacagacagacaccaagtcatataagaaaatgacatccttaaatctgacacctcgatgttcaaatgcatttgcagagcaaatttaccttctgacaatgaactggaacctttgctgcttttaacttttcatgcatcatagtttctgaaggcaatagaaataaaactgactttccaacagagttataacgagcagtacgaccaactcgatgtatgtaagatgctacattctcgggacaatctacctaaataaatgtaagagaaaggttagattctaaccataataacacactgtcacattccaatacccccacctcaaagccttaagacttgctctaagacaagaaacagaagcaaagactcacctgaacaacccagtcgactgccttattaaaatcaaggcctcttgcagccacatcagttgagaagagaactgagcgcttctcctcacagaactcggaatatattgccattcttttttcctgtttcatcctcccatgaaggcacttcaacggtatgccagggtgaagtttcttaaatacctcaaacacaaactttacctattaagcaaggatgtgaatgtttaatgttatggaagatagttgaactctaaagtggaaactagcatcaaaaacacacggtgaacacgaaaccttttcagatagaaataatttctcactgtttacatgtaagaataatcaacaattcgtcctgcaaatcctttaaaagccttccaattacaataaccacaatcagcacggctaaaaggccagaaccgaagttcagcaaatgcagactaagggcctctgattgattgtgttcttaatttttcgttttggcaaactgttttataaaataatttgaactattttcaagaacatgtgatttgaatcaagtaaaaaaatcttcttgataaaggacagagaagtggagttacctgtttacagcttgatagaaagacaagtgtttttgactgtagatgtctctttatgaaagtccatagcatatctaacttttgatccaggggaacgatcatcaccgtttgcttcaaaagagtaggagttgcagtcacagactcttcgtgcacacttatatactctgggtccttcaaacttagtcttgcaagatcttgaaccgactttgtttgagttgccgagaaaagcatggtttgtctacgctttggtaactgtgagatgattgcatttacttccttcttgaatccactatcaagaatacggtcagcctcatctagtaccaaaacctataaccaagaagtccactcaatcatcagctatttttgcaaaagacaaatatatgtgatcaagttcatctaacaaaacaacaacctacttactttggaagataaaatagagccattttcaatcaacttcttaacaaacactcattgaaaaaaaaattaaaagaatctatctacgagtttttttatgaagttagatatatctatagtattttaaaccaatagtttcttgtgtaagatgaaactaaattgaatctctctactttaactttaaaccaatatattcctttgaaaggaagaaccataaacttgttttatttgagaatttcctataactctatataggttagaagctaaaccaactgggccatgaatagcaaggttacaaaagagctcaactcaaaccacatacaaatctagtcacatatatactgtgcatcaaaccacagttactaactcaaatagtaagctgctggaagaaaaaaagttagaaaaacgaaacaaaacaaaatttgacgactattcaggccggtaaaattatgttatgtgttagcgtgtgtttggaaccacatcaagcggccaaaaaacgcacgttttttctgaagctacaaaacatagcttcacaaatttcacatgaatgcttcttgggacacgagaaatggctgtgcaacatgtatccaaacacatacttaaaagaaatttggaagccaaatttgagaaaatgaattaattgttattctcatttcatctatttccaaatagtaaacaaatattatatggacctgcatctgtgaacaatcaaaattgggagtttcatccatgtgttgtagaaggcgaccgggtgtgcagatcaatatgtttagcttgttgacacattctttctcaatggcaacatccccaccaccaccaatgaggaggccagcactaaaacgatggtgctccccaatagcattcaacacgccaaaaatctgaccagctaattctcttgtaggtgatatgattatgctcccaaccccatcttccgttccccatctctctctatgcaatttctccaacacctatcattcacaaaataaatccccaaaaaccgaataaatattaacttaaaaaaacaaaaacaaaaaatgaatatcattttgatctcaaacttacaagagtcgacgattaaattttgagaaaaacattaatttagtacatcaagtatcaatctatctcttattaagtccctaagctatatgaatgtaataaacaacccttaaactatataaacaaacagtccttaaacaagcttcactctctcgtattttcatatagtttagagactaacttagacaaatttcatatagattaagatctactaattgtttttatatacttttaaggactaagtacaggagagtgatacttagttactgtttggataaacaactcatttgcagcttatagcacaagcacttatcatgataagcatgcacttatatacaagcttacatgagttattttatagcaaaagataaaataaagctaaattgtttttgtatttgctgtaagctgtttccgtaagctgtcttggagaacttacgaaaataagcttaaaaaagcttatgaaaaatggcataagctgttttcataagcacccccaaacagtctcacaaaatttatgtcattagataagctcaaataagtcaaccaaaacaggcccctaaaactaaatctaaattgatggtttaggctttaattattataactttacgaaatgacaactaaatccctaaaaaaatgaacactttcaatcaattgagagactaaattaatcaacaaacacaatttctattagcaaaatactaaattagtgagtaactaaaaaaacataaataatcaagcagacaagcaccaaaatcattcaaattagtctatagggggctttttggattggcttatctactaacataatttagtcacttggctgatttaaagtgtacatttttcataagcttttttcagcttatttcgtaaatccctaaaaaatgtacactttaaatcaaccaagtgactaaattaatcaacctatacaatttctagcagcaaaatatcaattaaattagtgattaattaaaaaaccagaaaaaatcaaagtataaatatcaaactttcaccaaaatcattaaaatttcaaaaactaaaaccctaaaccctagtatactaatgaaaacactcacaggaataatgaaagcaagtgtttttccagaaccagttttggcggcaccaagaacatcacggccacaaagcgcatgaggaagagaagctcgttgaattttagtcatggaaacgaatttcgaatgcaattcgtcttgggttttcttcgatatcaatccgtctttggttttcttcgatatcggtaactgatcaaaccgcaccacgccggcatagcgtgagaacgttccgtcggcgaggcggccaacgggggagtttttggggagaggtggaagagacattgggtttgaaccggagtctggtttttgagattgaatccatgaattcaagaggttgattttgtctagttctgagtcgcgttgttgttttcgaaattgctttgatggtttaggttttctcattgttagagagagtagttaagaagctgaaggtggaagatggataaaacggcgtcgtttaggtttagtttgcggcagagtttcaaaaatgaggacgcaaggtgtttgtttgttataacgggttgtttgttggcaaagggtgggtagggttactgtattaccccaaaaaatacttatactagtcaatacccgtattcatacttttatacgtaatttaaatggaataaacaaaaatatattggtggttgataagttttctatagaactatatttttaagttttattttaagataaatatatatatatatatatatatatatatatatatatatatatatatatattgttatgctagtgtaaatgatttttttttgacaaatagtgtaaatgatttttatattgtcgctacgtaaaaattaatttatcaaaactaagatggtagcggtgaaaatgcattcatcttttcaattgaattggatatgagtcttcttagaaagttgatcttctccgagagactatgtagttctttcttggtacgtggggtctataacaaaagagtcttgtaagaatctcaattaattaatcaagttaaaatatactctctcctccttcaaaaaaaacatactccttccgtttttaaatataagcaaaattgactttttagattcatttattcaatgataaatgtggtttataaacgatattacaatattctttttttaaggaacaagagttttataaacgatgtcatattattttttagacaataataacatgacattttttaaattgaaccaaaaaaaaaaaagttaaagtgcacttttcgccccctatgtttcaaaatgttgcgattttggtcccctattaaaaaaaatggcaattttggcccccttcgtcccaaaattgctgagaagacgccacgtgtcccaaaaaaggggtcataatcgcaattttttgtaaagataaggggtcaaaaagcatatttcccttatgttaggaggtcaaaagaacatatttccctaaacacaggggtgacttttgccatattttttaataggggtcaaaatcgcaacattttgaaacttagagggcgaaaagtgaagtttagccaaaaaaaaaaaaaaaacatgacatttttaaaaaaataataacataaaataacattgtatgttttttttaggaggataacactgttatgacatgttttacatggtgtgtgacttgtttgtggcttgaacgagtgaagtggcgattttgtctctctgccatgacaacgcaaccatgcattgcattgcacttcatctttctcttcctatccatatcaggtatcttctcattctcccttctttttcatgtttttcattgcctcaacttttttatttttctactttcttctagttatttatttcatattgttatagcattagaaatggaggaaaaatcaatcactaaatgggtttagcttaaattattgtttttttttatttataattttacttgtgatatcaatggcaagttctcattttaatgtgtttgtttccaacttttatttctcttaatagttctggatgaagcttatgattctgggccagctttgttgtagaatattgtgaaggttttatatttagggttattggtaaagggattcagtgagttgaaatgagtgtagtagggtttgacattggtaatgagaattgtgtcattgctgtagcgaagcaaggtggggttgatgttttgctgaataatgaatcgaaccgtgaaacccctgctgtcgtctgcttcggagagaagcaacgatttttagggtctgctggtgctgcctctgctatgatgcacccgaaatcgatagtatctcaagtcaagagactaataggaaggagatttgatgaccctgatgttcaaaatgacctaaaaatgtttcctttcgagacttttgaaggttcagatggtggcattttgattcacttggaatacttgaatgagactcataagtttacaccggttcaaatattaggaatgctctttgctcacttgaagactatagctgaaaatgatttggggtctgctgtttcggattgtgttattggagttccatcatactttactgacttgcagagacgagcgtatctcgatgcggcaacaattgttgggttgaagcctttgatgttaattcatgattgcactgcaactggtcttggatatggtgtttacaaaacagattttcctcaaggagatcctatttatgttgcatttgttgatatagggcactgtgatactcaggtttctattgcagcatttgaagctgggaaaatgaagatgctttcacatgcttttgacagaaacttagggggtagagactttgatgaggttctatttagacattttgcagcaaagtttaaggaacagtacgaaattgatgtgtattctaatgccagagcgtgcaataggctgtgtgccgcgtgtgagaagttgaagaaagttctgagtgcaaacttagaggcacctctgaacattgagtgtttgatggatgaaaaagatgttagtggatttatcaagagggaagaatttgagaatcttgcatcaggattattggatagaatttgtattccttgccacaaagcattggcggacgcgggcttgactgttgataagatttattcggttgagttagttggttcaggttcaagaattccatctataactggattattaacctctctatttaagagagaactcagccgaacactgaatgcaagtgagtgtgtagctcgtggttgtgctcttcagtgtgcaatgctcagtcctgtttttcatgtcaaagaatatgaggttcgaatttaaacaaagcactgatgcttatcctatccatatgatatatattgcatactagatttttgagtttatagattctagagatgcaatactttgttaactaggtttattttctgtatttgaattacctatttctctttcgtctattcaaatggagatacagccaagtttaatttcataaacatattataccatttttgtagtattttctgttgtcttgtattcctctccataaaaatttatgtaatatctcttatttattcaggtccaggattctattcctttttctattggactttcctcggacgaaggtccaatttgtgaagaaacaaatggtgtacttttcccaaaaggccaacccattcctagttctaaagctcttacacttcagggcagtgatttgctccatttggaagcattctatgctaatccagatgaagtaccaaaggggacgtctccgaaaattagttgcttcacggtaagtgttctttagaacttgtgctgcaaaggagtccagaattttgattcttgtgcatatttctatgtgatatactgatttatattttcggttcccatccccttctatattttcccctatattttcctgcttcttgttttgtttcatgaaaggcctgtcgtgatgcctccgagttttttttgtcatcttaatttcgctgtttggcactcaaactcttatatagtgacgttctacagagaaaaatatgtggttacgtagtaataaggttatatcagtgattaaaaaggttgatgtattctgcatgcctatacactgtcatgatgcttatacatctgtttgccacttctattcagattggtccttttcaaagatccggtgaaagtaaggcggtagttgaagttagaattgacctaaatttgcatggtattgtcagtattgaatcatctacagtaagtaagaaacctaattttaatctcttcaatgttacatcatcagttctctcagagatctagctacatacatgaacctttatttgtcttcagttgatcgaagatcgtgtggaagattctgttacaccgcgtgagtatcaatccaattctgaagcaggagatgttgaacccatttctgagacggaacaaaatgacaatgaacatagtatcaatgagaagtgtggatctccacatcgttctgtaagtatgctgttgatgaacaccttttttaaatggaatatctcagatgttaaagatttattgcaaatcatccttcaaacatgaaaacccgtatagctaaattttatctgatcatctatgatgttaaattatatacagtctctcaggctataacaactgctcttcaatatatctgataatcatatatgtttatttttattttgtgaagattgttttgattgcagatatgattcatgttggtgatttgagtaaataaagtgttactatcatgcctttttacagtctgatggtacaagaaaagataaggccaacataagggttcatataccagtgagtgagaacgtctatggtggaatgaccaaggctgaagtcacggaagctcaagaaaaagaacgccaattaatgcagcaggatataacaatggagttaacaaaagacaagaggaactctttggagtcttacgtatacgacgtgaggaataaggtatagattcaatatcttaataagatgcagacatggtttttgtgactagataatttctgctgtcacacatttcatatctagctttgatttttgctatggtaatatgaaagtattgaatgtttcaaatgtgaatgagaaaaggctgatctatattcaataatgagtttgttttcagtgacttgatgtagtaaatgttaggtaaaactaagataatgaagttagtgcagtcacacatttcatatctagctttgactttggctttcgtaacgtaaaagtgttgaatgtatcaaatgagaatgagaaaaggcttctgtatattcaatgatgaatttattttcagggacttggctgttctgattcatgaataaatgtaaggttaaactaagatagtgaaactggtgtctagggatattgttttattctgctttgtatcaaatctgcatatgaaatgaaattaaaatctctatccttctttatcctttatgccaattatttaatacacggctttatgtgtgtatgttctatatttcctgatggcttggcatttaataatttgtgcatttttatgaatagctcttaaacgaataccgaaaattcgcaagtgaacaagagaaggatggcatatccaggagcctgctagagactgaggaatggctttacagtgaacgtgatgatgaaacagtacatgcttattttgcaaaactagaagatctaaaacaggttatctttttgttctccgatctccatgtttcctgtgctatacttcttgttctcattctacactttatatagctggtggatccaatcgagaaccggtacaaagatgaagaagaaagagtgcaagctaccagagatttgttaggttgcattgtcgagcatcgcatgtctgcgggttctcttccacaagaaaataaagaactggtacattaaataggagaataaatattattttgagatgcagctcttaatatcagctttcaagtaacaactttcatgttttagataatcgatgagtgcaataaagcagaacaatggctaagacaaaagacgcaacaacaagatgctttgcctaggagctctgatccagtattttggtcaagagatatcaatagcaagacacaagatttgaacttgtatgattttactcctctgttttttcttttcataaatgcataattatagggtgttatgatacacctgctggtgtgaccgtgtgacacattgttcatctggtgcaagtagtgttgtcaaatagctgctatggcgccatggcatagcagaatctgaacaaaacagtattgttccacgatacattatttagtacaaagtgttgtcaaatagcggtggtatagaactgtagtgtagtggaatttgaaccaaacgatattttccacaatccgcgattgacaagaccgcctgttattaacactttattcattacatccattgattttatctctagaataaaactaatgaatgttttattttgatgggttttagagtatgccaaagcatattgagcaccgagggttcttcatttccagaagaagacgtaggggaagacaaacagaatacttctgagcatcaatgaagtcagtgatgatggtgatactctgtgaacagaagatctaaattttcattagctgtttaacttcacacaaatgtatattttttttcggattaatagacttttacctcctgtaatatagggcacttttgattttgcccctgtaaaaaaaaattagattccgtccttgtaaaataaagattcttcaggattgcccccgagctctttgagtcagcagaatctcgaaaaagaaatctaaatgttttttaatttttgaatttcgatttttttatttaaaaaaataatttgaattttttcagatttttttaaaaatatttttcgtttttttttaattttatattattttttaaatataaatgacgtgtaaaatattttttacgtgtggcaagcaaaaaaaaaaaaagccacttaagtgccacatcaaagattctgctgagtcaatgggcttagggggcaattgtgaagaatttcattttacaaggacggaatctaaaaaaaaaatattacatggagcaaaaccaaaagtatcttatattacagagggtaaatgtctattaaccctttttttcttaggttaatagacttttaccccctgtattatatggcacttttgattttgccctctgtaaaaaaaaaaaaaaattagattccatccttgtaaaatgaagattcttcacgattgtcccctaagcccattgactcagcagaatctctgatgtggctcctatatgtctttttctttttcttattctttttttttcttgccacgtgtaaaaaatagtttacacgtcatttatatttaaaaaaattaaaatataaataaaatttaaaaaaacgaaaatcattttttaaaaaaatctgaaaattaattttcaaaattttaaaaaatctgaaaaaattgttacttttaattacttttaacacgtgcaatattatatttgttacacaaaccctaataaaaaacacttaatcatactatattgtttacgtaagaaatccaaatcaaacagcatgttattataattttaagaccgggtaattttttacctcaaacccaaattgcataacaccaataatatgtattttggtgggaattgattttctgagtgctccacgtaaggatttggtgtccagtatttccagatacaattccaatccaaaaaaaatttatctagagagtttcacatgataacacagttcaacaaattacttgcgcttgaatatactttttcattatgtgaaaagtcaaaaagggaaccagaggtaaaccttgcataaactaaaattcaggaacctttttatggctggaaggggtttgaaaaatataaataaaactctcctaatttccggattcatgcatgcatagtctcgtgtatatatgctgcaagcttcgccacttatatttataatgtatagggtatagcatggtccatatctactttgaaacgaccaccaatcatattatatataataatttgattaccattaactatgttataatatactaacggttattgaacatccatattgtaaaccaaaactcaattgaatcatactatacagtatacacatcctagcacacatcatttagaaataaacattcattcataaagccagaacacttgcagttccttgtacactcaactcgagatagaaagaagggtcttctcaatgtctttttttaacttgaaccatcttatccttctttttatatctctcatttacaaattgggatagcactaagcgaaccaagtggtgaatcaatgcttggtgaaaataaaaagtgaatcgatatctcaaagctacagtttcatggtatcaatatcttaaagcttaatgtgtgcacttcacagaaccatctggataagcttatgacagtgtcagattgttttgctttgaaacttcactgagcaacaaaagccccaaatcatgtgaccctacatgctagattggtagcttcttttccccatccagaaataaaacaacagaagtttatggcaatggaacagaaccaaacctatcgggtaatactagccataagaccaatcattagtaatttacaggatgctgtagaaaagtaatttactgtggacctggcagggaacaatgtgttgcatcaaaggcttagtttcccttcttggcgtttgctttcttagcacttgttttctttttggatttcttgaatcctgttccactctcctgtaagcataaaaggaattcagtgacatatcccgtttaaatataccataaaacaacaaagttatttgcaagtaaatgtaccttccgatagtgtttataagcatttcggccagtcaactcctgtccacttttgctgacataaacctacaatgtgaagataaagattcaaattctgatcaattgatacaatatgcaaaaaatgtgtttactccagctaattaacaaaaggctcaagacaatcatatggactgtaatgtgggtgaatgccaacggtaatttgcaatattgctattcatgtccattgctagaagataaaaggatttggggaatcaattgccgtttgctgaatctattaaaaaccatcaacttcacactttggttatgagaatgttgactacaaaaacaaaaacacattcgggcataccaaaaagagcttttaatcctttgacttctaccatgagatgtaaagcactgatattttgtgtgtttaagctgttgcaatgtctagaatgatatggaaatatggaatacaatgacagtataattattataatttgagagtatgacagatatatttgtattacgattaatatcagatatagtatcttaatcgtcgtaaaaaaaaagatatagtatcttaacgcaactatttatcttatggcatgtgatgctcattttatcataaaaatatgtatcaagaaccatattaaaaatacagaaatttgagttcaaagcatacaacaatatcttgtcaaacggaaaagaaaggcaatacataatagtgtgataatttagcttccatctgcatctgtaaaacactcaaataatatactacctgggtggtttttgcaattttcgttcacaatataacacattggttcacaacttcttatgatcagcatctggctataagagtaaataaatcaaaccacttaataacagttaacgttcttcagaaattttcaacatacctttcttccatctgatcctgtataccaatgaccagcagattgactgcttgcttgtacacgccttttacctgcatcttttggcataccggcgcggctcttgggttccacccaatttcccgaaacatttgaagggtttaatttgcattgtgcatttttagcttttgacacacttctcttagtgttgtttctctttgttgtgttctttctactagatgttccactgccaaaaggagaaatgatttttggatccacccaaccttcagaagcattaaaggattcctcaacattcaaatttgttgatttgcttcttctgcttgttgagccattaacacgtcccggtgttttagaagctcctccattgtcaaattgtcccctgaaatcaacacagaaaacataagttgattagatttcttcactgttatcaatagataaaattggttaaggaaagaatatactggaaagttacttcttacatataatcgatatgcgagccattttgttgctgattaacactattgacacctaatggaaaaaaattacaaaggcggctgcgaaccaactgctgaattcttggatcctcgtgtaaaaaataacgatgagcaggaggaagaggacccgccacctcccatatctgttcatcctgctggtatccagaactaaccccacaatacgtctcattgtaattttctgacatgccaatccctgatctcggcacttctgtgctctttctagaacaaaagtactcttcgaacacctcattgaacacgggtgtaggaacagaaaaattcttcatgggagaaaaatctttccacaaatcctgatttcggttcacatcaaattgtgtctttctatcttgttccgaataagtcaaaggcgtatttcggttacatgtttgccccgatgacgaagaggggccaactttattctcaccaccaacatcctcaccaaacagatcatcgtcgtcatcatcagaatcaagcaatttaaacctaggtataggactagtcactaacttgggaaacacgaagctactctgacctgtttccaacccaacagaagctgggatatcagaagcatggtctcttttttgggtcgcatcaaattgcgtctttctattttgttccaatgaagtcaaaggtgtgctttggttatatgcttgccccgttgatgaggatgggccaactttatttacgccaaaaacatcctcaccaaacagatcatcatcatcagaatcaagcaatttacaccttcgaataggactatctgctaaattaggaaatatgaacccactctgacccgtttccaacccaactgaagccgggacatccaaaccctgctttcgttttttccccattgagttactacatgaatgtgaagttaaaactccagctcctttcaatgagacttttgagctgccgcatacagatcgattctgaaccgaggaatgcgcagatactaatatcacaaaacagagacatttatttcagaatcaaaataagagaataaattctacgcactgatggtgtaaaatgtctttacacatgcatccaatcaaatcatgtcaaatagatatttgtagaaatattctagcctaggaactagcctaaaaaagtgacatcaccatgaaatgagttaattgagcaaatgtcggtgtacaaattaacttcatcaaaataaacactgtaattcaatctatactactaataattcttgagcagaaaaaaaataattattttataaaagagttcacaataatgagataataatttgtttgctatatatttctatcagattgagggcctctttggattggcttatttgggctcatctactggcataagttttgtaaagacgtttgggagaacatttgaaaacaacttgtgacatttttcataagctttttcaatttattttcatatgttctccaagataggtcatgaaaacagcttataacctacagaaaatcaatttaactttatttcataatttttttaatagaaatagcttatgtaagcttatacatgagtgcctatcaagataagcgcttgtgtataaggtgcaaataagctgtttatccaaacaagccgttaattctgattcaatttgtactaaaccctaaccaattaatttattgttatttttgtaaattaggcatttttaattaatggtaaataagataagaattaagaaactgaccttgaagaggttcctcttgggaagagaactcctcgatatcatcctcgtcgggatcaaagaacgaaggcagtgattccgtttgggaggaggaagggggagcacgacggagacgtttgaggatacggattggtgggtcgggttgagattctggatcggaatcggggacttcttgtgggaccgggtcgtggttgggggaggtagatggagaaggtggtggtgtatcgtcaagatcgagacctagggagaatgatggagcttcaaattcagccatggaaattgaaatccaaggattgtgatcttgttttggttgataaggttgtgtagtatagtgtggatttttaaataaactggattaaaatttggtgcaacattgtaaatgattttggcggggatttgaatttcagggagggagaaggaattgagtgattatttattacatccgacacagatattttagggtgggtactttacgaatctgagtttcattagtgttttagtttacccaaactaaacaatcttcatcgttaatgcaaaatcgaacggcatatattttgactaaactaaaatgtttaagatcaattgtttcttaatagtatatgtttgtatgttattcatcaaaaaaaaaaaaaaattaaaaatatgtttgtatgttaatttctttagcattttttttatgttaatgatatttgcattaataaaagtcttgcaataaatcaaaaattaaaggtgtggaaatagaatgtggaatctcttcaatctatatgaaatcgtcttacctagttaaccatcgatctcgacgttggtttgtatgaatattgtgccttgataaaagctcaattgatcccaagaaccaataatgactctttcactctaaaccgcgtcaacgaagaatctatcagaaatcaaagtcgtcctccttgtcacaatttgtcttcaactcgcatatcaaaggttgagtttccccgttttgacgaagaaaaaaaaaagaaaaaaggtgtgtctggttatacaaatgtgagcaattcttccccttggacgagatccctcaataacctagggttcgcctagcatcgattcactttgatggtcttgcccttcaatgacacttaaactacatgcgggcaagatacgatactcctccatggcaagagtatgctgatgaagacccctggctactttgattcacgtcaacaacaaggtgggaagatgcaagagtacgatgaaaaattcgaactcgttttaacccaagggtcaatacttcttaacattcccttatcatttttcttgttggtttggaacatagcacacatatgcatgtgcgtatgttcagccacacttcgatacaacaagctgcaagcttagcttgtccctataaatcatccaaacatgcaccccttaaacccttcaatcaccctccctattcacctttcaaacctccatcctcaaacactaaacctaaccccaccaataccaccacaaccaaaaacttacatgtgaccacacctattccctcaaaacctttattcattatatccaatcgaacttactatgcaacagattagctgaccagaaggccaatcacctttgcatgttttgtgatgaaccatttacacctagtcaccaactcaaacgcaaaaagtctcgattattagtgttggaattagataaggatgatgacggtgaggttaatgatgaataaattgtcatggaacatcgagatagtgcgtctatacttaaccctcaatttcacaatccccatctctcccttcaagccataactgcattgcaaattactaacctgtgtgagttttgggaatgcatgacaagaaatcattacaagtcttccttgatagtggtagcacccacaacttcttggacttggagacaactaagaaactatgttttaagttagaggttattactcctatgtaggttaccggaggggtagggtgtagtcaattaaatgctccctacatgtgtagtggttttcactggtatcttcatcaaattgatgatttttatttagattgcattcagacaaatgagaacttttgttagacatcaatatactgttaatttatctctgaatttagtttttggtttaatttatttcttataaagtgctaagttcgaaagttggttatgtattctgttattgtattaaattatttttgggtgagcctgttcgtcgtaagagtttgtagcttgaaattattgatgatgctccataagttttagtacactcttgaatttgagacttccgagttttatgcagtagccatcctaattgctgtactgaatatttttcgctaatttggtctgattcaaaagtagtaggttcagaacttttggccacttggtaaaataaaatgttcaagaaaaatgatgtctgaagagcataattcttttgtctgatattttttgcctcttagtaagtgatttttgaagtgaatatgtgaatttggtgatctttaaattgagcagggtaagattaaataaatatagtactatttatttgatagaaaatatttatggcttccacttttttttttttttttcagaattgttttcgcaaatcttatctggtggagcttaatacttaagtcacttttgatgaagattggaaatagaggagctttctatctgtgagtatgaggtatatgtaaatcaaatgctaataatgttattgctccttggtcggtcatgcatagtcatctaactggtttatatcctgcattctggtaggtatctctgcattctgcattatagaacctttggtaggttaagattcaagctttgaaacacctcgactcattatcattgcttgattatactgatgcatctttacttgcgtacaaattttcttcacaaaattttaatgagtatacaaattttcaagcacacggagtatgatagaaactaaaagtggaatccacttgtcttaactcttatccctggaatctgtaggcacaacacaaccacacaatcttttaccaacttgatcaatattttggacatccttgtgattgaggcactgattacttttctatgtccatacatgttcattgaaattgttcctcttatcctaagccatgaaaacaatatctatatagacttgctaatttttcaaatgagaagatagcttggcttctaattccataaataccatgtgcccatgcttgagggtgttgcttttctgttagtatctgttgttcttttcttccaacttagtgctgcaatcaaatttgcaaaataaaaatgcaggatctgaatatagttgtaaaattaattcataaatcttaccactaactcaatgtaagaactgaatgacaacttttaccaattttgagcgaatggttagaacaaataatatgttaatattcacttgtacttttatccttgtggtatttatatgatttctatgcaaaatagttattgagatattttaatatcaaagtgtggttatgtgcataatgatgcaagctttggcggagaaactccattgccacttcaacagatgctgcaagattatgatgaatgggatcttggcaggagggagaatcttgtgatgtttaggaaagagagggaaaatgaatagtgagaagtttgtttatagaaagtttgtgttaagactctccatgtaaaatcactgtatgcatgtaaaatctctgaatacattttattaagtcttggttggactgataaatcatgagtaggaatgcaaaatcatattcaatgatacaagagcaaacaatccattttcttctactgtgatatttaatgttttaacggttgattgggtgggtgggaccaaagtgttttaactttgatataaattaatttgttggatacgaaagtcttaatatcaggttataacaaatggattataaatggttgtagtacagtacatcgaaaaacaatgttacatgcacacttcttacaattatctagcatgatgttttgagaactcacatattcatggagtctattgaattgttcttccaatcccatgatttcccactcccagttcgactgttcccatttgcgacggtgagggggaaatatggaatggaatggaatgtgagtggtctacatcaaatttgttgtgccttagtagggaaaagttgtgcatggtatattgtcacattagaaattaccatttatttgaatcaaaaatgcaaaatttgcaacacacaattatctagcatgtcaccatttaattatctagcgtaaacactataaaacacgttcaaaattttggattttataatcctaataggatacatgagaaagaatagggtggaaaataacaatgttttattatatatactttggaattggttagctttttttattttattttggaatcctttgaagttcaacatgcacagctacatttttggtagtttatatatatatatatatatatatatatatataataatgtgttcgaataatatatttatttgctacataaaaacttgacaaaatgtttgattaacagagacaaacttgaactagaactgtagtgataattagtcaaagtatgacaatagtccctattaataccaatataacataataactagatagagattaattaagcctattaaatacaatgcaacatcaaactaaactatattgatctctttcatttcaaccactgtagggaaaatctgattattgccaccatcacaaccatgttcttggagctgattagttgaactagcttctacattattcttagcattcttgtatatgaggtataagatcatttgagagacgcctaataaaaatcccaacccatttggcagctaataatagaaaaatacaaaacattaatcagttttattgctttcagccatacatcataaaagaaaaattcattaataggatgagtaaattaaatatattttatacttaccataatgtacttatccttgtcaaagaagccatagaaaaaccacatggtggcacagatagtaagaaacaatgacaatggaaatggcatgtactctacacttcttgtttttatcaccttcttctgcaattcatttacaaattttaaaattaaatctcctttcattcaatgaaacacacgtacataaaaagatcgcgtcactactaaaaaaaatggataaaaagattgcgtcactactagaaaaaaattggattagaacaaataccattatacttaaaggagcagcaaacattccaatgttgaaaatagtacaaatcatccccacaacttgaacatggaaagaacctttcacaatgaaggtggtgattatcattgtcaagccaaaacctcccatgtcaacaataagtatcaaaaccaaagtggatatctgcaattcatcaaaacattaattaatttccatcctacatactaaggattcatacaaacacacacgacagacacgaccctgacactaacatgttgatatcgataataatttgaaaatatggaattatttaatataaccacatgtgtcggagttgtgttagggtacaactgagccttaagtcggtgctacataagttttcaatatgttgtttagaacactcttaagagcaattgcatgcactctagaggccatagagaaaataaaaataaaaattactactaacaaagttgaacttctatcacaaattagagatgaaaaaaaaattatttgttgttaactattggagatgttaaaattggagaacaattttatttttttccgatctttaattttggtaagtaactcaactttttcttataaagaatgaagagacaaaagtaggaagaaatattatttttatcatggtttttaccttgagcttcttaggagcatatgttatgtacattattaggtatgcaacttccataacacatccaatagaattgattgtgataagaaaaatggcattggtctttaggaagccataatatacaaataacaacgtactaagaagtgtaaccacatatgggattgaatgaaatccttcagatgattttttcttgtaaattgaatagaaggttggcctgcatgagacaaggtaacaaataagatatttgtagtattgcaagttatgattgacattttcatatcgcaattatatattatttaatttgtttgaaggtagacttacaatggagctaagaacgacatgaatgtcacaatgcctatagacagaaaaaaaaaaagagagagagaatcagaacaaaatataaagtagcaaacaaaatttaaaggtactagtattagtagacaaaattttgttagagagaacatgcaatacaaaccaagaataatgtgttttcaaacactttgttcaaaaaaaaaatgtgttttcaaacacaatgaaaaccatgttttgacattttaattttaaaaaaaaatactagatctaatttaaaaaattgttaaaggaaacaaaatatggaaagtagattttcctaattaaatcatcttaaacatttccatgacatcaaagttgaaaatggtgtagtgaaaaggttggaataagaatagaactaaaaatatagttttatttgatatacctaggaaaccaaagagcaaaaccatcttgagattagaaaagggaaacattttagagatagaggggtttgcttgattacaggacaatgtgtgcttcaaccaagcttgttagcttccatatatatagtggatagcacaacacttcacaaccaagcttgcatgtcctcgtgagtttaactcagttgataaggacaatgcataatatatgcaaggtctgaggttcaaatctcgatcaccacaaaaaaaaaaaaaaaaaaaaaaaaagactacaaattgcataccattttatctctacactcacaaaactcctctttttagtacactaataaattatcatccaaaaagtttaccaaaccaaacataaaaaaccataaggttggtaacttataacatttgttcatcctctcattgtgtctagcgttttgtctttataaactcctattgatttcaagagaaataatgacataatttatcagcaaaaaactttatgttttagaactaaagaaaccttaatttttttttagagaaaagaaaccttaaatatgtttacaaaaacaaaaaatttaaatattggaagagaagggttttgataaagttgcttttcgtaattaacaaattaatgattatttttgtcaattaaatagttatttgtaaacttttgtagttaaaaggaaaaaaaaaacatttcataggatacaatactatttcactatttatttaataattttctaaattttgcttgaaaaatattattcaactttcactattataaaaaatgttatttcattgaccttttttataaatgataattataagttattataattttttaaatgatattaaatatatttttttttaaaaataactcgtttgcctcttgatttaacgacaaagatattagtacacatgaattgacgcatgtacggtagaaattctcatatatttcacaaatattcaattctttatgttgtaacaaaatacttttgatttacaaaaaaagcttcacattagttagaattgaattgctaagaaaaatttataaacattcacactcttaaattctttaatttgtcttttattaaagacaaaaccgtgagagctaagttacataatcaaaagagaaaccttatgcaacatacttgagtttagaacaatttctaaaggggaaaacaaaataatgacgtaataatgattatatggaccacactactttatgcaagatgttgaatttgaggcaagtgtttttaaataatgtactttttaaatataccaactttttccttcttgattagagttttattgaaacggctttctattttagtattagtataaatcaatgatcaatcataataggcttccacaatctctaagctaattttcttttttgacaagatatattctagtcactagtcagtatactattttagttcataaaatcattaaaatattataatatgaagttttaatctaacactatttcagtataataaagtcattaaattgtacaccatactatttaagaagcctattgattataataaaacagaaagcagtattagtataccaacaaataattatactcctccgctatgataaaatcaaaaacaaaattacactgcttccccgaaataaaaaaaattatactcccctaaaaaaacaaataattatactttctggtaagaaaacagataattatatttttcgtgctatttttaaaagggtggcttagatttttattaataaattgtaaatttttagcttgatttatttagcttataatttaataattttctttagtttttttataaccatatgatgcaaactatttatcagctctgctaatgattgaactttaatgaaatatttggctaattatctttggtggatcttcttctctcgcaatcaagtttttcaatatttatatgactcaaacatgaaattttgtttaagagatttgagtcattccacactcggaccaacacggtgttgattttaatttatacatatattcttaatattttgagtttatataaatatttaacccctgaaaataatatttctatagtatcattgattttgcgactaatgaatacgcaagatatatctaggacaaaggaataaactcaacaagaagatagaaaacctttgtcaaatcattcatggggaaaataagtaagtaatacaagaacgaagagaaaaaagggtacagacgagaattgtccatggagatttcattgacttcattgggatcaagccaaaccattttcgtgaccatgcaaaagagaaccctaattcttttggttggagttgtttgaaaaaattgttacttcgacatgtgacactgttttgacatcaatatttttaaaagaaaaaaattgatatcaaaatatcatttttcttgattatgatagtgcgatagtgcaccgtgattttagtaaataaaatcctctatattttaccaacaatttcaaggtaaggttgagccggcatggatgtttaaaatattataaaatatctcccaaacaaatataaatttttaaagaaacatgaattaaataagaatttttaaacacaaaaacatacaaattcatatttaatttattcatcgttaaaacaaatcatattcgcatcattaacttgttgatctagtaggtgattagtctgagtttaataatgatacattgtagggatgaaaacggatcacacaataactaaggactcgatctttaatttaaaaaagtagaccatacttaagttagactgaaattataactatggagagtggattttcgggttctcaaagtctagtggagttgcttccaatattgtggtcgaattacttgttgtttgttcttaatgttatttaaatctacatttggagaaaggttgtacgaccgtgaagaatcataggacttatagtgtcgtagatcattctcatagagaagagagagcattcgtttctatgccaggaccacatcacccttataaatcttctacaacaaaatcctaagcaatgacagaaaatcaaaatctagaatgctatcatctatattttatgacaatttgtttttacttaacatttgccctatgactagaattgatacgatacagcacgagctacatgcttctcatgatttatctcaagaccctatgcaatgtagtaagaccagttacaacatattacaaagtaaatccttccccaacatattccattgtttgagttatattatatttatggcatatgggaaggaaaatataatgcttaaaggggtatgtgcaatccatttatggcttctcataatctgagcaatttttttttcttttttacataagcagcacattagtatcttcttcacaatctaaaatgaactgcttcccttaagtcattgcagaaggagaatccgtgcaatggctctattgctcaaatctaaatcttctgtttaagaacatgacgcaactgaaccttctggctctccattctggcctccaaaagtttagctttcaagctatgcttctgtgcaccacgaggaatgcatcctttcataccccgttgtttatgtggacttgtggactcagaaggactaaactggtattgaatgtcattagggctcagcccccctttatctgatccttggtcaggagacatgatgctcccgttggataaccttccatttgaaagcttcccattcattccctccacagagattatcttgtaattatcttcattggttgggcatgacctccaaagtctcgtaatggatgatgccttttttgattgcttagttggtatagagcacacttcattaatttcagttattggtgtctcctcgcctgcattttcttcccattcaagtacacttctccgggaaatattactctctcgatggttcctgttcaaagattggacacactcttcaggagaataactcgagccttgatcctcagcttggctcacagtctcccatccactttcatcaccctctatatcaccattgtcatccatatatacatcggaatgcctcggaatgccatccttatacattacatttgcttcaggactcactgtgtgaatcttggaggcatgactaggaggactgtgagaaacacactgttcaatctccctctcattgtgctcaccaaaatttaactcttcaaaaatggcatagatatcatccgacttggggggttcgtatgaaaattccttaacatcttcaatgttcattgcagctgcagcttgtttaagtaaatgtgcttctttcctctccgttgtgtttagatccgcattttttgacttgagaaaagtttctaaatctgcaacaagtttattcatctgtgaatacttctcgtcaagagcaacttttgcatctatcaacttcatttgaacacgttcttcacgccatacttcagccatctgtaacatctttctctcctcttccagttcttccctaagtttcatagattccctcttcaatgcttcaacctcagccttgtcttctccaatttccttggcaagctcatcacacacttcctcaaccagttctcttcccttcctctccttatcataatcctgcatgtagcgctttgctgatagtttcacatctgccaactcatttaccaacctcgaattgataatttcaatcctctggcgacttttcctttctcgattcaactctgttttaatgtcatcaatgtacacacggattttctcatgctctctgcttcgccattgggccttttcctcaccaactttcttcagaaaatgatcaaatttctttttggaggagtggtgttcagtctcaagctcctgaatgcgtgcacgtgcctgctctagttcagcttcaagagcagatacaacagatacagtatttaccttttggttaagaagtttcgcatatatatgttgtgccacatctgctgtttttagacatacaggatcccactttgttgcaccctccatttcagtattgagcaactggaaaggtttgagctgaagaacatggtacacagaaattaaaacctacttgtttattccttcactttaaagcttaaacccttagctgagctaaaaaatttaaatgctattttcaacaagtggatgtgcgtgaatgaaaaataacaagtgttttgtccaagtcagagtacacaaatatctacatacatagcatggatctatgcaacaatcattattatctggtaactaccaaggcaagccccatgacccaactcatctattgttttatttattataaaaaacataggtaaatgagtacacaattaaaaaattaaaaaatatacaatgtgatataaatcaacaattgaaatcatgttttaaacatataggttcttctggcttgaataacattgctatttatttatttatttcaaagttcaattaagccaccctctgggaggtggggggtgctggccacatatattattaaatatttccactactaaatcacaaacatgttggccatgactatagtatgttgatatctacagcctcactttataaaaccatacccccttgcagtaagatgaataaatcatgaaaatatgtaaattgcataagtaaccaggtaacaacaacaaagaaaaccatgcagtacaggatataatcttaacttgggtcatttacatgtataagacctaaattcaataatccttgatcatgagaatgtaacacttgtattggtttgattgaagtaataagatgaaccatacctcacagttgtgtccactctttgtcccaaagacagaacggggactttgagactgattcttcagatcaggatcatgagtcatgcaatttggacgaccaaggaatgggaggcctacatggccacttccattctgcagacaagtgacatcagtaacatgctaaaactaaactacaagcctatcaatttgataacggaaaccaactaccaatatctgaaaatgaagagaatggcatatgaaagctaataaatgttcaattccctaattcaactggatatcacaaatacctaataactgaatatcgtacatcaaaaaaacataaatcaccaaatccaaataaagtcgcaacttatttataaacaagcataaaaaaatgtggcttcacaataccagcaaacctacagatcaccatgtttgtttaaaactctgccaaacatgacccaacaataaatttagtctgggcatatgctgtctgatcaacaagtacagtatacgataaaataatgtcacttatctatctacacagacaaaccccactcaactcatttctacaattattacaaagaataattttaactataccaggttgcacgtagagaacttcatcattcatgagtaaaccaacaaaagcaaatattcaggtttaaggctagtttgaataaacagcttatttgcagcttacagcaaaagggcttatgtataagatatttctatagcaaataataaaataaagttaaattattttggtttaagctataagctgttttcatcagttctctcaaacagtctcacacaacttattgcagtatataagctcatatatgtcaatccaaaaatgccctaaggacctctttggattggcttatttttgagcttatgaaaaatagcttatgcaaataaataagctattatgtttattcataagttctcactaacgaaaaattatatcttcataagctgtttcttcataaactaccttgacaagcttatgaataatgcataaaagcttattcctttgcataagctcgaaaataagccaatcgaaacgggccctaatctaaaacttaactctaaacgctcaatctgaattc

SEQ ID NO: 43 - DNA, 114267 bp, Medicago truncatula; identical to SEQ ID NO: 23
  misc_feature (37187)..(37286): n is a, c, g, or t
  misc_feature (37411)..(37411): n is a, c, g, or t
  misc_feature (38103)..(38105): n is a, c, g, or t
  misc_feature (38107)..(38107): n is a, c, g, or t
  misc_feature (38130)..(38131): n is a, c, g, or t
  misc_feature (38134)..(38139): n is a, c, g, or t
  misc_feature (111454)..(111553): n is a, c, g, or t

SEQ ID NO: 44 - DNA, 131488 bp, Medicago truncatula; identical to SEQ ID NO: 24
  misc_feature (2119)..(2119): n is a, c, g, or t
  misc_feature (2136)..(2136): n is a, c, g, or t
  misc_feature (3702)..(3702): n is a, c, g, or t
  misc_feature (3739)..(3739): n is a, c, g, or t
  misc_feature (3784)..(3785): n is a, c, g, or t
  misc_feature (3819)..(3819): n is a, c, g, or t
  misc_feature (3832)..(3833): n is a, c, g, or t
  misc_feature (3935)..(4034): n is a, c, g, or t
  misc_feature (5587)..(5587): n is a, c, g, or t
  misc_feature (10720)..(10720): n is a, c, g, or t
  misc_feature (10993)..(10993): n is a, c, g, or t
  misc_feature (10999)..(11098): n is a, c, g, or t
  misc_feature (31008)..(31107): n is a, c, g, or t

SEQ ID NO: 45 - protein, 236 aa, Medicago truncatula; identical to SEQ ID NO: 25

SEQ ID NO: 46 - DNA, 711 bp, Medicago truncatula; identical to SEQ ID NO: 26

SEQ ID NO: 47 - protein, 250 aa, Medicago truncatula; identical to SEQ ID NO: 27

SEQ ID NO: 48 - DNA, 753 bp, Medicago truncatula; identical to SEQ ID NO: 28

SEQ ID NO: 49 - DNA, 92896 bp, Medicago truncatula
agccctttctgttcatacagaagcggtgccacccccttccttttctttttccgatacatgcaacatggattgaaatcgattctgtaggattttatttagggatgtttctccctttttggtacttttctctcttcaggaccaacatatttttctgttaaataaggattgccgtgaaagagtctgttgcagttgccaagtatcatcattctatcgaaaggaaacctagaacaaggcccgattatagtgcacaacccaccaagaagaagaaacccattacagaaagagattatgatactagcattaaaagtgcctcgaaaattgtttagccaatctaggtgagaaagaaaatcctttgcttataaggatcccttggtgaattccaagcttgagatgataaagaaggagcatgcaccagcagacaacaaacgcgcgtgtgctttttccaacctttttaatcccagcccttgattttctattttgccacatgtcacacatccatgatgataaatggggtaaattgagcaaacctaaatggagtaaagatgaactccacgttcttatgggatgagtcaactttgtatcaaccggaccaacctagattggctaggtgtttaaatattgttctgacaatggcaaggaatgagaaaggagagcaagagtcacaagagattttttgaaagacaaattagtttagtttaatatagtaatctggggaactgggaaatagaatactagcaaagataatcaagtatttattaaaccattatttaaataaaataacaaatattgtggtgaccggatatcaaaagcataatttttaacatatgcatcgacaactttgtcaaaaaaaaaaaaaaaaacatatgcatcgacaattattccgaatcacatttatatttcaaatgaggttgcatgtgataaaaaactggcaaccaaacatgccattaagtttccatgttagaaagttaaataaagcttatattctgccatccatttttcatgttatttgtttttaatgaaaaaataatagtaaaaaacaactgcagtcacgaactcactatccaaagctaaagagcaagcaatatcataagatactacttatcagaattatttttcaataccatttcccagacaaactaattgtatccagacctaacccaaaaaagacccgaacagaacattttgtttggaagtaagccaactaaaagttgatggccaattgcatgccggttcccattcaaaatacgcatataaaaaacgaaaaaatgagaagtatcctatttgaggttcaaaacataatcaaatgacagccagtttcaccagatgggaactctaattcgaatcacttctgcagaggctagctgactcttggtaaatgtagatctattgagacacagaagcacgctattgagtacgatcagatccatatgcgggcaatgtggatgtcggttgtagcatgtcatgatttgggaaatgcattcctggtggcatgtttccaggtggcatttgcattggcctttgtagtggcatgctcccaggtggcatttgcattggcacatttccaggtggcatttgtagtggcctttgtagtggaatgctcccaggtggcatgtttccaggtggcatttgcattggcccatttccaggttgcatttgcattggcccatttccaggtggcatgtttccagctggcatgtaaatgttattgtgcatctgcaatggcatagattgagcaactgttggtagagttgttccccatcctgcctgagattggggtatcatagccgggtcagaaattggagtatattgagaaccattatactgctgagcaggaggaaccgtcatgggaacaggttgccctaaaattgagggctgagtgttcacaactggtatcataggaatggtatagtctctactcctatcattattgacctgtaattacaaaaatcatcgttgaaattaaaccgaatctgtgaattcatattacatgcagcaagcttacaaaattattaaccagttgatcgctgccattgcttccccttcagaatgtataaaggaaaatataatactgaacaacaaatctaaaattacgacaggtttcttatattaatattatcacattttttttattttttaaatacagtcaagagattcagaaagctgtgatgtagaccaatgattatagggaacctttcaagactcaaagttaaaggattttcagtgaatgatacactgacatcatcccagaaaggaatatcaaggtctataactagatagtccagttcttcagtatatttaactaagaataatcccatttctctcatctttgaggttaggaatgctgagatcctaacaagttatcataatgtttttaaggcatctccaattcatatactctttcaaggattcatttaaatgacatcaatcctcagtctgggttgattatttacctttatactaagatctgtatgacgtgagtacgaaaggtgaagcttgcaaaaacctccatcatatatgcagtgtccttccaatgcttctttggccacaacagctgtctgagtatctgcaagccatagcatgtaactctgaattctcaaacttagaatgacagaatgacagtacaaaataaaacaaggcaagtagtaaatctctatctgctgataggttgaaattccccatgtttcgatgccaagtcaatgacataaaaatgcatagataacacttgaactatcattgttatacctatcaaagataactataggcattgctgaggagattcctagtgaggaacatacccagaatccttgagaaaacaatcatatctttggaaataatttagaggaaaattgagagaccaagaaggtgcagctacaaacaagtatctttgttaaatatttctatccaaaataaatcaatctcagtaggatcacttttgattgaaggattattagatcacaagaggcaggatctccccggcaatactgcaaacaaaggagttcatctacatgcatatgcaaatgcatactgtaacacttgccagtttcctcaataagccataagtgttcgatttttttcatagaattggacaacatagaagcacatttgagaactttccctaaatgcaatgtctaaagctttaggtgatatggataacagtcggcaagcacacccacttggtttgcattttgcactaatactactaatgtagagtacaaacataatatatccaaatgctgaccagttaaattcttcaaataatcttagatcgaacctggatattgaatcagagcctgtaaaccaccattcttatcaaacattgcaatcttttggataggaccaaaagcagagaaaacctatcacaaacaagaaaattgtagaatattattacctaagctgtattgtcaaaagatactgtaaaaacggttgttcaggcttaaaagtaccatatgtaaaacatccaacgttacagcatattgcatgttctcaatagatgcaagaagaacgttactctcagcctccagtcttttcccatccaaaccaatcatgacctggaaaaaaaaattaaaaatgagtacttcaaaaaagatcttcagtatgcaaagtccgcatacaagggaaacccttggtggaaggcacacacataactgatggtgcatgaaaaaagcattcaagttaactttagcaatttggaggttttcaattacacaaagcaggtggcaacatatctaatatgctatcccttaaaacaaaacagccaaaacgttacctgtccacctccctcaatggctgattgagcaacaggaaggtaaggattagtatagtctctggagcatgaaaaataaccaattagattatttttttaatcagaatagaaagtaaaagggatcatagctgatcaagggtaacatcaaattaaaaaagtcagcaatgctttgtttcctgtaagccagcaataccagggaaaacagaaatacctgctcctgtggctttgaaacttcacagttaaatctgaatgtccagagtatgtgatcttgagggtgcatggtcccacatgttcagagagcagatatctgataatgagcgagattaaagatcaacaatccaaaataccaaaattgagaaatattaagagctaattaatgtttcaataaacatcaagtttcagctcgaacttgggacttcaatttattcaagcgctgcccagttggcactcgctaatcatattgactgattgtcattgtaaggagcacgggaagagctatgggaaatggattgaaagtttaaaaatgaatgaacaatttagttgactgatagtagaaaaaagatctgcttttccaaattataccagaatgatccttctatcctcatatcccccctatttatttatcaaagaaatatcctctaactgattgttctaactcccctaactaattgatcaatttgattcaacttccccaaccacttgtcatccttttgtcacaatatctagccttcaatttcattgagtgaatgataataggagtaagaaatctatgaatgattcccctacttatctaacagatatcccctctaacaacctaaattccctaactaacttctacaacaactgtcccttccttatatcataataattaatgactataaaccacattctgtgattcatataattgcaaccaactgcaaaaagaagtatataaactccgtaaaaagacactgcttcatctctaaatataagaccctattgacaaaattacgggaattaagaaagttggtagcaagtttacccttcatagtaattattgcttacaaaaaagatgtgaaataaattagaggtgtttttattaaattataattaatgcagttggaaaattagaagggagtcctgtaaaaatgagcaaggaaatttctcaagagtatcctatctttaggcatggatgtagtatatacaaaaagaactaccagagccaatgcagaagaatcaaacagttggctattcaatcatctgagaacaaaagcaccacgacatctaaccaccgtatgatatccattagttgaactataaacattggcaaaagtatttcaattgttacctaggtatgcttcttccatccaaagcatcctttgcagaagtggcagtctcagcatctgagaactgaaccagtgcctaaacagtggtgcatagaattagcttgtggttgctgcatcaaaaaagggacaacaaaaaaatatttcatttcattaacctggaatcctgcagtcttctcaaaagtagtaatcttatgcacaaatccaaaagctgaaaagacctgcataagcaaatgttaaactttcaagaggacgtttagtaagataaattttaaaatttgaacacaaaatgaacaaaggattttgctttctaagctatgttatagaaaaatagaaatactaaaaatcaaaatttcagcataagtaataatttatataaacaaccaagctccattttatgaacacagaagatagggattaaaaaagaaaaccatgataggacttaaataagactgcaggtttaaggctttaagcaaatcaatacatatcttgaaatgcttatgttgcatgcattggtggtatcacaagaaatagaacattgtaagcaacgagcaaaaccgatgaaaaactaagaaaccataaaaataattgccaaaaatttctcattaaatctcaaacattaactgcagaaagtggaggaattagttaagccaagtgacatatttcaaatcacaaatttcttagatgaatagctgccagtggctgcaaggaatctataactgaaataataatgtaagagttgaaaggaaagggtattattaactttaatacatgaatagttgattcaaacaaaggatttacgaagttaattgcctcctgaactgtatattttgtgaaaactaagcatttaattgccaagtatagaatggaacttttagcctacattaaaagactaagaaaatctaaaaaaacatccaaacaatagtagggacgcaaatgatggtagctaatctatgcacaagtaaaatgcatatgatgagtcaatgcagcatgggtgcacaaatcagtgaaaaaatgaggcaacatcctaaactacaagagtggtaggagttcaagagggagactagggaagaaagaggtagtgataaggaaaggagaaaagagacaaacacacaagcgctatttctcccaaagcactaagcttccatcgaagatattgccttcacatgggcctgctgattcatttatatacatgtcaacaagttttccatatcctggcaaagaaaaacctaagcacagaactaaatgaccagcatcctcgttatgaccgtgttagcatgtacaactgatgcacacatgcctttgctattttcttaccaagtgcaagacatcaatgctgacaaggcgtgcgtcttcaccctcaaccgttaccaacaatacatttccagcaacatctgcagcagttttgttatgcactatttcttgccgatttgaatattgcagatatacagttttccctcgcacttgtgcaggctccgatgatgaggcatagtatgaaatcattgcaatggcttgattcaaatccgcctgtaaattattggtaacaatcagtaattttatttcatatgaaggacaaaacaataccaagaaaaaaatataagaaaaaaaaaatcactcacaaattcaataaaagcttgattccgattcgacccgacattgcactttgtgttcacaactttgccaaatggattcccaagttcaatcagctcctcctcagtgcattcccatggcaagtttctcaaatgaagcaccttggatgggggctgggtgtaccgaaactgttgctgactagagaccgatgccatttcaaacaataactctacctgctgaattgcaaccccttagacttacaatatccaatttcacaatcaggcatcacactataaagcacagactcagacacgacacggacacgtcgacaccaataataatttgaaaaaatgacataattcaatgtaattgtatgtgtcgtgtcggtgtcggatacgataggtagctgaaccggaactcgcgtaatccgaagagtatatgtgtttcatagttatcacatcatacatacacaaataatttccaacaggttatattaaccacttcacacattcatgatttaactagcatgcttcaaaaatgaaccttaatttacagataaaattatgcaataacacctaataaaaagaaaatctaaacaaatcagtgcagtacagtagctaaagagaaaaaataacattgtgtttagggggtaacatttccatgaaattaaaattccagaaaagaaaaaaaacacataaattaacctaaaccgaatcagtttcagacaataatgggcctttagttatcgaaatctacaagaataaaatcagaatgtggaaacgaataagggaaaaaaaaattcaatcaccagagagaattgagaagataaaagctcagattttttacaggttcgagaaattagggttgaaacatcaaaagggggaaacgggaacgaaccttctccgttaacaagcgttccgttttattgttcccgggaccccgtctggaaagacaaactagtacttatgacgtgcctccaccttaaaccttaatcatacatcataaattcatgattttattttttgctaaattattttgcttatgtgttttatatattttttttattgttgttaatttagttctaatctcaccattcattcatgtcatatattttcatacatgagttttaacatgcatgtgagttgtattttgatgtgatcgtttgcgttgtttggatataaggctcgaggttttctgtgtattttaaatgtaaatgttagagttcgtcttataatcgaaaattcatgatggtgaatcatcgcttacaagtcgtgcaattgtgtgtctcatggttgaactaatcaaaggaattctcataattgctatatgatttcaggagctgggtaggacatctctctataatagtgagagctaagccactataaattcgtctcacatcattcatccatccatttatgttgtatatttgcatacatgagttttaacatgctttatggaagttgtatttggatgtatcttctatgttgctcgaatattggagtcgacgttttctatgtatttaaattgtaaatgttagggttttttttttttgaaggaatgttagggtttgttttataatcggaaattcatgatagtgaatcatcgcttccaatttatgcaattgtgtgtcttatggttgaactaaccagaggagttttcataattgtaatacgattttcagaaacagggtaggacatctctctcttataacgagagctaagccattacagtactaatcactcaccattcatccttccatttacgtcatagatttgcatacattgtgtaagttggatcctgacttaatcttttacattattcgaacatgcgagtcgaggattctgcatactttaaatgcaaatggtactttttatcaaaaatatcttcatcgctttcaattagtgaaattgcatgtcttatggttataataatcagagaattgtcataattgttatgtgattttcaacatcaagtaacatggtggtgcatctcttttttgtagtgtggggcgagtcattctgcacagaaccaccacttaggcaaactttggaaataggtgatcggattgtcgtgttgcatatataaggtgcgcgtgacaaatatggttgtatgtgttatttttgttttacgtgtgacaaagattttctttttataggttgcgtgtgacaaagatattttttacaatttgttggcgggtgcataacatatattgaaggtaagaaggatatgaaagaacaaccacacaaagactaaacaaggggtatcagtccccaaaacattagatgccaacaaatggctaaactgcgacagacacacatcaaaaaataaaaaatcggaatccaatgaacctaaaatttttgctaatgcaccaagacgttccagttcaatttcaacaaccgtcgaatcttccactttaagagccatatcctcacaaattaaggatttacaccgccgccactaaatccacatgcaactcaatgggcttaaaaccaaataatatatcatacctaaaaccttgaacaccgtcacaactcctccacataagcacaacaacgccttacattcctagtaaaaacacctggccactcaccatcgcttcctcttacaactcctccacaaccaacaaacacaccctctttacaagaaccatcaatattcaacttcacccaaccacgcgcatggggtttccatcatataagaatggtctcacgcacaactttcatcatttttacgactactacgcatggtgatccaacccattagtttgtcttggttatctttgtaatatttcatttttctcctttttggctagttatctagcgttatttgtgttgtaaacacttttgttctctttgaatccttgtgcgtcaaagagacattttatctattatatcttttggcttctttaaaaaaactaatttttaattttttaatattcataaaagtaaatattgattattttttatgataaaaaataaaaaataaagtatgattgtcataaataatgaaatgatattttctaaaatataatagtcgatgaataactctttatttcataaaaattatcgttaattcattgactcgaaaaacaagtgcatcattatatatttatataaatttatgcaaagcaaatgtagctcaatttgcaaatgtaccgtaaaagctccataattaaaattatatatttatataaatttatgctgcgtataaacataaaacgagttgggtaatctaagtcagtatgcctctactcattttattgagggaagtatttatctatttgttgttttgaaatttgaatctcaattactacggatctatagccagctcgcacaatgtttatatatattagacaaagagaaatgagagaaatgattgataaaataacaacaaagaccgtaaatcatgatccagtctgaccaagaaggacatccttataaggagtgggaaggggtatatcaactttggtctcttcactaatttgacggttaatcattggttgatgatgacccaaaatcaagggaacccgtccttctcttgcacttactagtctctcttgtgctccacctcgcaatttctccaacctcatcgttccattcatttgttgcattttgaacacttttatcaaatttgtcaatccaccaatgaagaacatcaagcttccaaatatgccaagccaaacccaagtcccaccctgaatcataatcacaacaatccaagcataagattaagaaacatatgcatgtttctcaaaaaagaaaagggttaaattttgggcatgtttggattgaatctttggattgattatttgaacttatataatgtcattgccacattggcataaacactttgtgacatcatcttgataacttatgaaaacaacttatgatgtgttaacaattttttttcataaactcttcatagtagcttatgaaaacaagcagttttattttattttatcttttattatagaaatagcttttttatacataagctgtaaaatgtgttgtgttctcaaaataggacctattcgttggcaatatgtctaccaacatgtctacgccgattcaaatctatctcatacccaaaaatttgttgatacaccatgaactatataatttatttggtgttcttgaaaatcactaatggactctaaatataaaatctctagtgctttttctttcttcatattacatgtattttcccaacaaatttggatttttcaaacacacctggactttactaattaactttaaacaactcaagctcaaacaattttttttttcttcggtaaatcaaacaactttaaatattcggctcaactcattttttaaacgttcaatgttactaattagttattagactttatcttacatcgagtttcaacttgagttctcaaattctcttatctcttaactcaagtcacttgagttatccaaccccctcaactcggctcgtttcacctaattatcactaatctcgcaataattaccacaaccattaattaaaatagctagttggtgtaataattgaagtatgtagagtacttacaagcaagttcattccatggtggatgattccagattgttgatgatgattaagaattgcaccaagcatgaatgacaaactccccatcaaaaaagggatatacacaaactgctgcaagatttgaacatgtccatccgctctctcataaatttgacacgagttatgaatcgatcctaccatccacaatacaggaccagcaactagcatgttcacaacatgcttttccaatttcaaataatatcctttctcttcctgtcccacacatcaacataaaaataagcaaaagacattttccaatttagattgaatcctatacttggttcttactaatctttcagtgtcctaataactcatatcactagattacacatttgaaaactaaacataagttcgttataaaatcaagatatgacacagtaggttaaggttcaaacccgactactaacattttatcctcatgtaaaaaaactaatcaatattttctatcaaataaaaaaaatataagcatgtgtttggacagactgtataatgtaacatgtaatataacttttgtcaaaatcagccccgtatgtcaaaatataagcatgactctttacgaacctcgatgaaagtgaatagaattcctagaaagatgagaagcgatccaaggatctgaacaacaggagcagcaaactcaacaaacaagagttgaagatcaaagggcaacaaagacgagcggaaatcaatggcagcaaaatgagcaagaatatcatgaagattaacaaagataataatggtaagagcaataagaagaacaacgaggcccgaacgggcttcaggagaaagctgggccacaaaaccggaacaaaggatcacggtggcaaatagatataggcctgcgtttatgtattcgtaacggtttctagtgaggcccgggccgtatgtacggaactctcttgctgaagctagtttcaccattgtctgaaaaggaatgtgtgtgtagtgttgggttggttggttgtggcagagagagagagagagacgttgaagagaggaaagagttgagattttggcttggacacgtggctacttgcatggagttgtgttggtgtactgtgacatgtggcatgagcagagagtaaaaatgccggtttttgcgggaaaatagggtagccagccatgtcaacagatctggttatggttatggttatggttagtgggcctatgttgggcttacgtttccttaagacccaagcaagaggagtaaatgaaacaaacaaaaaagataccaactaattcactgttctagacttgtagatttttctcgcgcattaatattatgattcaaattgattgtactatacatagtatcttgtcttgcaaattttttgggcgatatttgtggtttgggataatagtttaataacttatttaacactatgtttggtgatcatatcattcttttgaactactttttctctatatctaaccaaatttcataaaactaaagatttctccttaacctattttatttgtttgttttggtgcatttatctactttttttgaaggaattggtcaaattattgttatgttgcaagtagtggtgtggattgatccagctttccttctattgattgttattttttttttgtcatgcattaggattgttacttatctactttaatagatttgggcttgttccatttttacatcctatttattaaaattgcacatttgattttttattttatttttatatactattctaatcaattttagtcatttttaattgataaattagattgacatattttcttattgaattttaagacaaagacaactcagcatgtgtttgttttggcattgaaaattcacgtttagcatctttttaataattgagtttttgatcattgttttttttgtcaacatcaacctaagaaaattcaacattatattcctcccaaatacccatcacttttgcaaagggagaaaggacaactaaaatacaaattaaagtatcaacttgctcagttgcttgatactcacacagctgggtcctggataacttcgttggtccttgattaactacgtactcctggttttggtttataattataatctgtgtgtgcagctaaattgtttatcttctctgatttaattttcccattaacgctttttattttttacttttgtgctatacgtgcatgtcattttcatctttgttttcacatttttttaagagcttggttttcccatttgcgaaagggaactttgtaagaaacagctgtaaaaactactatcatcgtaaaatatattaaagctgtaaaaaatattgaacttttcgtgttaattggattttttgctccataattcaaaacccttaaactaataagctcactgtttacgcatggttcatgacttctgatcactatttttctgagacaatgacttcatgtcactactactagtaacaggagtgtgcattttagtccactatttatgtataattcttcttgattcatgttaaccccccggcacatatataattttggacttacagggaattcactaagtattttaattcctagatcctcaaacataaagttaaaaaaagatgaatgatattgattgcttaactttctactaatatctagggacaataattaaaaaccctatatacctcctgaccatagaacattaaaatgtttgtcttttaaaaattctcaagtgtattaactgttttaatagaatattatcaattatttaacatcctttttttttttgtacaaattattttacatcatttatcaaacccaataagtaaagaataaaatttataaatggtaaatttgaaaaatatactaattatcaactctgaacataaattaactataagcttgttactctatgttgcatctctttaagcaaaaattcgatgcccaacgtcgtacactattcaaaggaacacttacaatgagacaaatatagcaaataatatcaataaaacattcttccattaaaaaaaaaaatcaataaaacattttttttaacaccataccaatccaattatccactccaccattgccgaaagttctggtgttaacttaagaatattcaatacaaaagagtcaaaaaggaagagaatatcactctaaacaagccaacattattgagtccgccaatagtccacgtactttcttttttgaggaaaagttcactgatgtacttattattacaccaacttgatccatataaattttggggctgacatacacattttcaagaagtaacatgtagggcataataagtccattctgttatccagatcgaatattcatccaagaatcaaactagtttaagaggttgaaatcccttaccactatgaccaagtcataattggtggaaaaaaaatgattcacactacattaaaattgaaatggttgttcatttttgtacattttttaaatcgatctcacattatagattatagagagtactgactttgcttctttttatttatagcaatcaaagtaatgcattttattaataatcaaatgagaaatacaatacgcaataacacttagataagatgataagagatctctttcaactaaaccggaggttctggggttcgaatagagtcacgagaatacatcactgttaaatttcttgatggagagctttgtcatttacgaagatcctattcgactcgaaagattaatctctgcagttgcacgcagatgatactcagtacacacaaataacatcacatgataaacttgaggaaatattatttaaatcaaagagtacaaccctaaacataaactcagatgtcactcacatgaatgattgttgagatattaaaaacgtaaaataaatctacatctattatgaccgtgacatgtcattcactccatatatctttttagtttgatctcctctttagtgaatggcatcttatcatctaccttgcacaaaggattgtacaagaagataaagaggaacatacgaagtgggtcatacttcaagtggcattttaaaatgaagcattttaagtgagtcataatcatcaatcacaactaacccaatatatattgatgccgagacaaattctaaaatgaggcattttaaaaattaagtaaaattattatacttctatttaaattatattttattttgaccttcttaagaccccagaaacgtttataaaactattgtagttgtttcatctagtactatttttttgaataatagtatttcctttttttttttttttttttttttagtaaaaagcaatatatatatagaaggattctcgattcatttaacaatataaagtctgataaataaacaagatgcaaaaaacaattgttaagtttcttcaaacataaccatgcaccttacaatattctaatgctgaaacctaaacagttcttcctgatgaatccatgcgaattccaaacatttgagtgtcccatggcctgtagcttcttggattaatcgcaagtgacagtaaattcattcaatatttgttgagataaagttgatcttaaataagatttggagattgctagcaataagctctttaagaacatctttaatggtgctcttattaaaaaaatatatgtcatttttgttcctatgcatatattaaagtctcaaaactagagagggaatgcggctaaaggagaatcaacttcaaaaaccaatttgttctcttctcattatatatttgttaggttatcatgtgcagcaaattctctcttttgttaggattatatgtaattaactataactcttacgtattacttttgatatggtgattatatatattaaaaatcttgttattcataatctcaatgctttatcatcaacttaatgattttctgaattgataacttatgaaaatgatcttttgatttaactagtccttaattctaaagactttttaaattcgaatctaggatgatttatctatgaatgttagaaatttacctcattcaatttcaagtataagcaattttttccactttttaaggtcattgaataaatgatgattaaaaatttctctttaaaagattgataattaaaaagtcactagcttgagtatctcacccgagaaaaaaagtgaatacttaatgttcacacacaaaagtgaatatttattagggtcttcaagcatcccaattttagtatctactccaattttcaaaagtgctgttacaatatgagtattcttttaaaaagttaattattacaattttcaatgcatttgatatagtacaatttttcattaaaaacttatcatttaaagtgtttaaagagtgcccggaacactcgttaatatttccctatttataaaagtagaaattaatgtaaaataaaatagtaagagatatgctatatttcgcaaaggaattttgtctcaaattgatgaattgcttacgtgttatcattgtaaaatgtttggtcaaatattcaagggtttaataagtttttagttcctatcaatatttacaattttgcttttagtctctacaaaataaaatcacatcttttagttcctgtgacattttttttacgcattttatagacaaaaaatgttgatgaaaatttttgatagagactaaaaatgctgatggaaaatttttatagggactaaaaatgttgatggaaaactttataaagactaaaaagtatgattttattttgtagggattaaaaacaaaattcttaatatttatagggaccatttacttaattaatccaatattcaactaaagtttttgaaaatcccagtatgggtggatgtaaacctgaaaattttaacaaccttcgttgtctcttgcgaaactacaattcgctatagagttgtgttatttgaacatccatatatgcgataacttttgtgacaatcaaaattttacaaagaaaatgaggtagtgacacaaaaatcaaagcaatagagagagaaagtaaaaagatagaggattgatatttgaacaatcatttcatacaacttttggtgacaacttctttttctatcttttcattggttaaaaacaatggagagagaaaaaagaagagagagaataagaggataatgtgagtatgagagagaaaattgttaaaaaattgtcacaaagtggttgtacaaatatcatatctcaaaaatataatatgagtatgagagagaaagttgtcacaaaagttataaaaaatggttgttcaaatatcatttctaatactccatccgttctttaatgtaggcatttacggcctttttcacatttcttaaaaaatgttgtcagtgtaattaatgtgtctgttttgtgtgttaatattaccaatttattctttgtttatatgtgtattaaatttggcttttcatatttcaagacaagttagtagtattaattaggggtatgtttaggaaaaaaataataaatgcatctagtaatttgaaaggggatttaatttagagacaaaaataaagtcaaatgggggcttagatatatagaccgaggaagtattttattatatttaatgcatttgaatttaattctttaactttaaattaattaaatgtacaaaatttaaatatttttttttacttttaggttgcttgacatgtgtcataatgacacaagttagcatgtttaattaaagagtgaagttattaattatcgttgcattcaaaaagtaaaacacttactttaagaatgagagagtaattgatatcactagttctactttttaaattgacaagtttagagagtttgttactcgataggaacatatgtaattccacgaaaaaatctttgctatcttgtaggcataatcaatttaaatttagaatttatttaaaatttattgaatagaacctggtaattccataagctaattttagagtatctaaacttattcaaaacttcttggatttgtcaacttattcataatgagaagaattttattagattgctacacccatcacagggagacatttcattattacaaaatatcaaaaaacacataaaagaaggaatcttgatacttgatagaactctaaaatccttgaacttttatccctcaataacatcaacattgttcacaatttgtgacaatcttttccactttcaccaccttctctaactctatgctacccttctccaaatccccaattttcgattcttccataaccctctcttttctgtatttgaagtaaatcacaagctggagtatgcttaagggagttccaaccagactaggaccctgtaatcatagtaccaaaaattaagaaaaacaatattagtatttctatttaactaatttttcttagattaattaatgagattatgtatgattaagaaacaaaccgcaacaaatacatcacgaacaaggattccataagctaaccagaatacactagctgaaaaagcacacaaagataatggtagtggcatgaattccacactctttgtttgtatcactttcttctgcaaaaatcaaaatataactttgttaccatctaattacaagtttacaacatcatgcttttgttgttgacgattgttaatctatgtttgatatcaccgtgagcgtgccagaatcacggtatgatatcaaacatagacagactaaaaatgttaatgtaaaattatgaatggaaggaaaaatgagtgactcaccattgcaacaagaggagaaccatataatgctacagaaacaactaaacctatgctaccaacaagtaactttctatgagttgtatcgtgcaagaaaaaagttgaaacagctacggttatgcagaacacaagtagaacaggtgtcgtgatcatagctaccttcaccttcatattgcaatacaacataaatatcattagtcactttctacctatcttattttttaatcatgcgtgtagataactagatatagtaaaaaattaaacatgcaatttaaaaaaaattagttaaatagaagaataccccatcaacgtcatcattttaattaaaaaaaataatgtaatgaaaacttcatgttgatgatgctttaattaattacctttcctttaggcgaagaataccagaagtatataagaacataggataactcaagagcaattccaactccattaacggttacaagaggaaaattttcccatttgtagcttacaataggtaacccataccatgtgaaaagaagacaattcaacaatccaattatgtaaggaatgcatgaaaattcctcggtgcttttcttccttattactcttttaaatgtaaccctgaaaattaaccatgaaagacttcaatacttcattttctccaattaagagtggtagatgatgaattaattatgttatgtaacttacattggcgccgcataaagtgagactgaagcagcattgcctgcaagaacaccaatgaagtaaggtttaagaaactaaggaatgtcatttgtatggttctaatgaaattaagccaaggaaacattaattaattctaatgaaggagcttaagctaaggattaaggaatgaaattgttagactcaaatggttcacaacaacaacttgagttcgaaaaaaaatgctttatcattctttactttggtggccgaatttcaaaaatcgaagggttaagaaaaaaaattaataacgaacaaacgaaataataccaagaacagcaacagccagacgaagtgtatttgacatctttaatttgttttttactctctacttagaagaagaaatgataatattttgtattgtaccacgaagaagaacattgaggacatgctctatttatagtcgttatgtaggacgcgtatttaattaacatagtagtgtccagcttgaaacaagtacgaaaacaaattagaaacttgggaggaaaataagtcaaaaaaaaaaagtggtagaagtgctttctacgtagttaataatcacgtggacacaaatttggttcaacttgagaagtttttttttttattttttatcaacttgatcaatattaccaatccagaactccagcttttttcttatcattattattattttccataaactttggtgtgtgtgggtatgatagctatataattgacaaatttcttgcgtgacacttgatatttcatgtaatctatcatattttttggctgtgtgtttatttatttataatattataatataatttatcaaaatcaagtgccttttctgttggtaaagcattataagataccaataatgcatattaaaacattacaaaaaggatttgttatgatgacgtggctcccattttggagagatacatatgagaataaaaaccatttgattcttttatgtttttacatgttccatttgtgttcaattttttttatttgaagttgtgaccacacaagtgtttcttttgattaagtattgtctgatctaatcaattaaaaaattgacaagtttcataatttatgaaaaggaagatttaatttgataggtatgatcatacttacaaatgtcttaagaacactacataagaacaataaaactttaaaaattgtattgaaaaaataatttttaaacttctaaaacgttgaatcaacatttaccaaaacattattagtatatttatttccttgaacaatattttaaggacactaattatcattttctgaatttttacacatctactgtgtaaaaatgttccacattatgaatgcggatcctctccacataacattgtatgaacctttacacaatcgaaactcatccatttgacccgaattcgattcttaaatggaacaattattcgccatactatacctaccttgcgaccaaacatcggattgctaatatcctatttccatggaaaaaaggggttaaaaaaaaaaaacgcaaccatttgattaatctaatggttgagagattatgagaacaacttactatttcaaattaactttacctctctatataacacacacacactctctctatatatatatatatatatactttcatatattaattatatgcatattaattaagcttttgcaacaaaccatcaaaaactggtgtggtgcaaatcggtttaactgaaccatttcttttgctccaacctttaaattttatattagaaaatatttattttaagaaagtataattgaaaatccaatgatatatacacacacacaattttccttatcatttttgttaatatttttatcttatgagttatataatataattatatcttaattaaaatttgatcacattttaagtttattactacatgttatcttaattataagaaactttttaagtattttaatgtcatttatacaaaaaaatgcatatgtaatatgtagaaggtggaccacttaacttctagtcaatctatgagccaattttcccgtacttgtgtggaaatatatttggacaagaaactcattttaaaattcattgcgggtgctttagatcgtgttcttaattttgaatatgaaggattacatgttgtgtgttttagttatgggaaatatggccacaaaattggaatttatccggacaacaatctttttgatgtgaataaagagacagataaggtcctttttgattttatgatggtttctttgttcgggtttcggaagtgaaacaactagtaaacttgaattctacaatgaagatccattcggtttatataaaaaaattcgcaaatgaatcagaaagatatttcatcagaagcaattgagtgataaatctcaaccaaaaatttcataagcaaaaaattgtgaaaatatgaaaggaaaaaacatagataaatgcaattaatttttttaatgttgatgaggtaattatagatagaaattttaggagtggtggttcacatgttacataaaaaatttcaggtgaggtgtcgacattaaatctttagtgggtttaaaggcaatgatagttcataagtctttgaaggagtcttaactctcaaactaggatcgagggtctgctaaccggtgtctccggggcattggttaagcataccataaaaggaaattattaccataaaaggaaactgtttttgactttattatcaattaattacaatttcaatgcattaattactatataatttcctttttcatatccttaaccactgccccggaggcaccggttagcatttccctaaattaaaaggtacaaattgtcatattgggtctaagcatgaagaaaagaatgatcaaattgtcactagctaggttagaatggtcttcgtagcattgccctttcgatacttagagtgttcatctttccaccatcccttagatatttaagagtagtcataatataccattatcccttcggaaaactgtgctttgaaatattttgtcccttcgaaatttttagtgatcctatcgtaatattagagtgttcacattatcatactggagcatccattgtactatattagaatgatcatcgcatcatattgaagcagtcatagtactataatagacgggtcataatactatagttaaagtgtaattttggaacgatttctatagtgcttcagaagttcgatgtaatttaattctgaacaattttatcatgcagatgttgtaggtgatagatacacaacttgcacaattttaagtagtgtcatgaaactttttagaaagtgtaacctaatgcttgataatccattggtggaatgatttttaaatattttaagtaaaacattttaacttgtttttttttttgaacaaactaaaatgagataaaataacaaaaagttttgatccctagcataaggagtgccaaaggaaacaaacatttcaacttgttatttaaattcataaccgaatatgatttttaaatagttttcgaagcacaaaatttatataaattatacatagaagtaaataaataaataaaaagtaagaaaatttgagttccccaatcccatttacatgctactcacagcaccaacaaaataataataattaaagaacattataaaaagttactttttctcaaaactcacctaaattcatcacaaaatagataggaaataaactcttatacttaaattaaaataattactctttcatgactaaataaaaattccagaatttaaatttacttgatttttttttcattttattaatataataaaatattttctactaattctagcactataaaatcaaatattataaaaaaatatgttcgcatcctcgacactataaaatcctcaaaaaaaaaaaaaaaaaaaggaagttgaaaataatttttatagcgtcgagggtgtaaaaatatttttttttatgatgtttgattttattcaagtgttttttgaaaggaactttttcattcaggtgttcttaccaattttaggattaaatgtagttgaggaaatggaacgtgattgccatgtaatgatcagtttggggttaaaattgtttcaaattctccatcaatttctccctaaccaaaccaatcagaattatttctcatcaattcccttaatcacatttacagtaatttttttgactctcctctcgtagtcttcatttattggatattaatttctttccttcataaagttttcaccaagcaaggagcctaccctatacatgcatcgacgtgctccttatgctaaatagcgaactggtcatgtcgcactccccctcctaatataattaatcactcaaataaattaattaatttttttttgagcaaataaattaatttatttatcactcattatactactaacatcttaaaataatttttttttctacacattgctaaaaaaaataacacatgacattaacttaataaaaatcaaaaggtagtaataataaatattttcacacaacaaaataatatatattagttcaagaatagaataaaatatcaactattgatctaaggttataaggagaacgacgcccgacgagctttgtaagtgagcaaaggggttacatagaaaagacactttggccttcaagtttgtaagtgagcaaaaaaaatagttttaggatagtttgatcttgtcttagggaactttagaaatcctcttttaccttttttatatgctaggatgtggagatccttggagtgatggcgaggtagtcgttgggtgatggttataggtggtgcggtcttaaatgtgagatggaccgttaatctatccttaaggtcacaaatgtcctctagaagggctcaggtgccctccagatgggttctgaagccctaggcgcgtccccctaaaggtgcctcctcatcaagcttctagaagcacctagaatgttgtaaagtgacttagggctcaagttacttggggcttaagtcacagaaatacaagcccgtgaaagactataaatacccctcttgagatcattctcatgacatgacctaaacagactaaaccatagttttagacattgtaatcattgcaagtacatgagaaaaaggcgttatgaataacttgaatccaaagaaacttaacgtctgcagtagtaaaacggagtttgtgttatgttttggactttggatacttgggccttagttcggcatggatgtattgggccaactgtgtgttcaggccaatgttcgacatggatgtattgtgcattccaaattttaaaattcggattcatgtttactatttcagattttataatccggacaattcttatgtataatcatccatcagactctctcacaattcaacagttttgagttttgcttttaaaaacaacaaaaaaactaagtaaaaaaatgttaaaaacctgtcaaataaaatcataaaaatagcacaaaaaaattctaaaaatcaaataaaactaagggttaatggtgctttaccccctgtaatatatgtcattttttattttcccccctgtaaaatatttttttgatttattcctctgtaaatattttttttttggaatacccccctaataggtcataaaaaaacgaaaaaattctgcaaaaaaaaaaataaagtcgtttttttatgacctattagggggtattaaaaatatatatatattttacaggggtaaatcaaaaaaaatattttacagggggggaaaaccaaaaatgacctatattgcagggggtaaagcaccattaaatgcaatttttttttggatttttctaagaatatgaaaaatttaaaaaaaaaatgaaaaataggtctaaacgatggaatttttgattttgatgggcggagtcccgtaagaagtttcttctgcgggagtaatggtccttgattttttttttttttttttttgggaagtttcgaagagattaattgtccaatcttaatttgattcataagcagtgcaactgtaaagactcttgcaagcttccgactctaatgcccgaaagaaaaggatacaatcatatgtaaaaagcaaatctgaaatacaagatgttcttctaaacctttgaaccacttaggagatataaaaccaatttggattgctattaacaatgctggaataattaaccgtgtgttaacacaaataaaattccattccatccatttacaatcaaaatccatctttatcgtcctcaaataactccaatcaatgatattgtatgtcttgctaatatcaatactctaggtaacattcttggcttatccctcatcccatactttattagggttgttcatgtccaatccaatccaatgtaaatcgcaaccaaaccaaaaaataaaaaatcaaacaaaaaaaacccgcaattttaaatggattggattggttttcggttcctttagtataaaccgatccaatccaatccaaaacgaaatatttatacttgtatatatgattatatgaattttttataaatgtttcattaatttacaattttttgactattatctaaactttctctataattatgttgacttttttttctttcttttaaaaaatattattaatttacgaactatttttttttaacatactattttatttggtctatgttgcttttattttctacttattcatcttttcgtggccttacttttttattaaatgtcataaaataatatattttcttaaaaaaataaacaacaatgaaaaccgaaaatcaatctaatccaaactgattttttttaatcggattggatttgatttcaaaatcaaaccaattggatgaacaataagaaaactaaagtgattggatcagatgatttttcctcctaaaaccgaaccaatccaatccccgaacacccatacttcatggcattgaatatttcaactgcaacatgcacattatgaattatagaccccctaagaatataaaaaaaagaccaaaactctaaaatgcccacatataaaatcattcagtcaattagctaagaatttagaatcaattttagaaaagacaacagaaagagaaataggctttcaattagagacagtcaaaggcttattcttttaacggtgccaatttcacttggttattttatagatagttggctctacttttaaatggatcacgcggataatatcattaatctttcatgttagttcgttcttggatcggataccgaatttaaaaagaaaagtttattgttttacacaaatcaaaagatatttttgattaatatacacataacttttcatgtacatcctctaaaaaaaacaacttcttaaggataaaataaaagtacagatgaccaaaaaaagttgatataaccttgacctttgagatgataatttggatatttttcctctaaaaaattgatagttaaaaagtaactaattaattattttttatgcaaaaagtcacttgcaatgagacggaattagatcctctcatgtcctttttatcccgccatccctccttttcctaatccaatggttgattgatttacaaagtaaaaaacaatacaaaggagagagaaaaacatgtggggtgaatggttgagattagtgcaacacaaacaacataagagaaatgataggatgatccaaattccaatgggactaataaatatgactttttaaagtgaatacttaatgttaaaaaaaatgtgaatatttaagtttatgtaagatctaccaaaaaaaaaaagtttatgtaatttgttatgcatggaaattcaatatcacccattaacaacatgtttataaacaataattgatattattcgttctactttctaaagtgatttgataagtttagagagtgtttcttttgagaggaagttagagagtattgttttaaagtagcatatataattccatgaaaaaaatatttggtatctttttttttcttctgtgaggagaacaaatatttggtgccttgtttagataccgatatcttgtatgaatagttaatttaaaattaaaatttattttgaaataattaaataataaagataatataacattaaataagactagatattaagcaatatattatattcaacaaaatttgagggtattcgagcgtagcctcagcttgaatacgcggttgtaatccacgtttttttccctccaaaatcacggaaaaagcaggcattaatgtaggctttggcgataattgattttgggtgtatcgattatggaaagttgattctgattaaaattaaaagtgagttgaaattgatttgtatttaaatacatgtaaaagtaaattgaattatgaatttgtgctagaatcaattctagaataaaaaactacaaatagtagcttcatttagaattacttttagttcgcaaaattaatttctcaaaaaaaattgtcaaaaataattttaaagagttaaaattacttttggcatttggaaaacattttctagctaagaaaagaaatcaaaaaattaaaccaaacactctattagttttgatcatcaaaagagagagaaagaaagagaaagatttgattacaacacccatagtgggggatatttcattacagtatacagaaaaacacataaaagaaggaatctgaatataagtctctaaaacccttggacttttgtccctcaacaacatcaacattgttcacaatttgtgacaatcttttccactttcaccaccttctctaactctatgctacccttttccaagtccccaattttttgctcttccacaacccttgcttttctgtatttgaagtaaaccacaagctgtagaatgcttaagggtgttccaaccacacttggaccctgtaataatcataatagcaaaatttaataaaaaaacaatacatactaattaattaatgtgattataaagagtgattaatttagaaactaaccgcaacaaatacatcacgaacaaggattccataaactaaccaacaagcactagctgagaaagcacacaaggataatggtagtggcatgaattcaacactctttgtttctataactttcttctgcaaaaatcaaatataacactgttattgttattatctatagtaattattacaatatgttcctcttttttttggtgatgaattttgaatatgtgaaagaagaaaatgactcaccattgcaacaagaggagaaccatacaatgcaacagaaacacctaaacctatgcttccaacaagtaactttctgtgagctgtatcatggaatgaaaaagctgaaacagctgcaactatgcagaacacaagcagaacaggtgtcatgatcatcgccaccttcacctgcaaattataaatgatgaaaactttagacatgttgatagatgatggtgcttaacatatgtttggtattatgtagttgtgccagaatcacgacgacctatcgtgatttgtcaaaagttatagagtgtggtttggaaaatcatgatgggttgtcccgattttaacataccaacgtgataccaaacatacacttaatttgttttggttgcaaaagattttaaactaatgaaaagctggcatgtaagttaactaattacctttcctttgggcgaagaataccagaaataaatgagaacataagataactcaagagcaattccaactccattaactgtgacaagaggaaaattttcccatttgtagcttacaataggtaacccataccatgtgaaaagaagacaattcaacaatccaattatgtaaggaatgcatgaaaattcctctgtgcttttcttccttattactcttttaaatgtaaccctgaaaattaagcatcaaaattaaggattcaacacttcattttggtagataatgagtggtactaatgaattgattatgatatgttactcacattggcgcagcataaagtgagactgaggcagcattgcctgtaagaacacaaaggaaataataattaatcctaattaaggaggagcttaaactagctaaagaacgaagtgattggattcaagtggttaatatgttaatcatttttctgagactagttaagacaaaaatgaaattaagaaatgaacgaacgaagaaataccaagaacagcaacagccaaacgaagtgtctctgacatgttaaatttgttgtttagtctctacttagaagaagagatgtaatgtaatatttttgttttgagagaagagcattaaggacatgctctatttatagttgttacttaggacgcgtatgtaacatggtagtgtccagcttgaaacaaaaccgtacgagaaagaaataaaaaagagaaaagaaattagaaacttgaaggatgaaaaagaagaagaggcaaaagtggtttgtacataagtaataatcacgtggacgcaatatttggttcaacttgagaagctttccatcaacttgagaattccagcctttttttctccctagtttttagaggcttattgttattatttcccataaattttgctagctattattcacaaatttcttgcgtgtcacttgatttttcacgtaatctatcttatttattttttggctatcaatttacttattatttgtttataatatataatatataatttattaaaatcaactgattttgctgttggtaaagcattataaaggtaccaattattgaacacattattaagatgatttgttcttgatgacgtggctcccattttggtgagatgcatatgacaatgattattaagttaggggtgattgtttcatgtttaaaaatgacattcttggaaatacatgactagagaatgattatactcatgtttgttataaggttgagaaaaattattattggatataaagcttcttatgaataaagtaacttccattaatatcatgaatttattcctatgtaagaaggtgagaatgtgcattcctatgaaatcatatatatatattttattttattttttaaattgtgacttccaattttctcagaaatgtcaacttatttgccgaacactttttttttttaaaaaaaaaatacctagtacataatccaattttcatatttttattttcagataagtaatttcttagtataatttatgtgtcgctgaaataaacacccccttataatttagtttttttctcgaaggatgcgcctgaaattggactgtatagttcaatttgaagggttaattaagaaattgaagaaaagaaaaataattttatgccacaatttcaaataaaaatgatttagacacacataaaaaaatatataattaattattttaaaactatatatgcatcatttaattcttttaagctttatctttttcatttatatttgcgtgtttaaataatttttatttgaaagttgtgaccatacatgtgtttctcttgatttttaaaaagttgtataaatatttgaaagggtacacttttttctaatgacactagttaagttaaagaattcaaaaataaaaaatttgtattcaaaacaaaacttctaaaaagttgaactaacattttcctacatatttttactatatttgttttcttaaccaaaccttaaaaatatttcattagtatttttctatttttttttactcatatacattgtaaaaatattttgcagattcattccgttatatcttatcgctatagcactttctaatattaagacctattatcttcaaatagattgaattattcctacacatttccgctacatttgttttcttaaccaaaccttaaagcatatttctctagcattttcctaatttttacacatctacattcattccgttatatctacattgtaaatatattttacatattcattccgttatatgttatcatcatagcactttctaatattaacacctattgtctttgaatagattaaattattcctacatttgttttcttaaccaaaccttaacattttcctgatttttacacatctacatgttatagcactttcttatattaacacgaacacttctttacatttacattgaacattaattacactcttgtgaaagaaaaaaaaaataatccaagaaggcttaatcgaatttttctaatgttagagattggacaaaattttggtttgagtgtaactatctcttcacggtttaaacttttactaatgtaaatttgatttattggaagcttaatgttaaaagaaaaattgtcttcataggaaaattcattttagattttcttgtgtttacgagaggagaatacttgtgttcacaaactaaccaatacttttttttcgtcaatgaattagtctagttggatcaattatctatttgtgctagagaatgttctttaaagatatagggttggtttactttcttataggtttcaatgatcttattttggtggatttgttttacacctcccaacttttgtttttcatttttatattttttttaataggctaaatttttttcatttttatataaataatacctttggagagattgtataggattggtggtacatttaggtgccaagatagtttggatctcaacatgttacaatgatacaaccttctccatatttgcttagtttctttttatcattagtttaatataattattttaactatttgtgtattcaacacattaaaacataaaaaaacaatatttttttatatgaaagttataaattatttccattttttgaatcctttcacaagtgtcctaaaaatacttgttagcaagacccaaatattaaacaacggttaatttgaagttaagagagagtgcattccgtaagattttagatgattggtgtctaagttacatgtgtaattgctattttagtgatattttaatacaacacctctctaaaaaatattaatatatcctcaacgttaatttaaagagtcccctctaaaataaattaatttagagactcctccaactagcgacatgacaaaatttacagcaacatttttttttcctaggactgatccataaatcgatcatatatagagcgattcatgcaacactgaatataggttgtgtgcactcataagtcacaacccgttggtttaacggtcgtgtgtattcacaaccctataattttgcacagtcacacatatttcgatccaccaattaagaaactactttttatatttaagactcactaatctattttagattttaaaaaattaaaactgctttaaaatctagatcatccaatattggttagaagaccatgatgtgtgtaaccgtgtgtggtgaaggaacgtatctcttatcaaatgtaatgtgaaaaggtacttgtattagaattgtattaacaacatttttacatttttgctttttctagattacctttgaagaatggtgggtaatttacccaccaaccaatgaaaatgaacaatttgttggtgggatcaagataattcatgaataccacttaaaatgtgcttatgtggctaatgtgtattggttagggtaaattacccaccattcttctatgggtaccctaattgtcacctttaacagtacattctattgagaaggttaagtccaagcaaaagactaaattgagagaaaatgagttatttgaaaatgatagaaggaatattacgatacaattaaggcaaaatacacatttatacggtgatctcaagtaactagcataacaaacatccacctagttataacaaacttttaacccttaaaaaaccaattctaacaaatttttaactatatctaacatattcgtcaattcaacatttactggtatatttaggtgagttttttttttcaaaactattttctatcatttaaaaaattataatagctaaatattatttaccaaaagtttcagtgaaatgaaaataaatttttctgaatctttatattcataatagtcaatattgaatatttttttaagataaaatgtaaaaaatttatatgatacttacaaacaataaaatgatttttcctaaaatacaaaagccaacaaatagctcttttgtttaaaaaaataatctttaatatattaatttaaaaacaaatataccaaaatcattcaataatatgtgaatgtacacaaactcctttgcaataaacgtatctttgatcaacacaatccgtaaaataatgcaaggaaccaaaatcatgcaatatgtgaatgtactatacaaactcctttgcaataaacgtatctttgatcaactcaatccgtataataatgaaagaaaagtgatacgaaataagtcatttgtgtaaagcatcaaaacttctagaaaacatatttgtacaaaataagaagcctaattgctctgtgcaaaaggtgaagttacgtaatcccatcttcttggtgccacatagcaactgaattaatgctcctcttagagggcattatgtattttttttccccgttgaaacagcacttagagttatgtacttatcctattgagggacattttatgtggtttgcatttaagcaaatattatctacctcatataatgtatggttggaaaatcaagcacttgtattagaagaaaaaaaaatcaagaattaaactcaagtaactttaaatacattaattacttaagttttttaaactcaagtgattaatgcgttcaagttaatagtcatataaaaaaattgaagttaaatctgagtcaaaataccttttctatacgagattatttatctcacaattaaattttaaattaccaagtcctcattcccaatgctctaaaaaaaaaaagtcctcattcccaaaaaaaattgaagtattaaaaaaggtatggaggtgaaactaaatatacacgtaaataaatcaagcatgtaagcttataaaaaaatcaagaatgtctcacccacaattaaaatttgttatctgttcaggttaggaatatgataatgatgttggctggaggaagaaagaaaagaaaaggaagacagttaaaaagctaaggaaaaaaaatgaagaaaatgtcatagcaagtgctacttggaactttggtacggtaaagagacaacccctcttcattttttttttttgtggcagccgggttcgaacccagaaccttgcatattttattcattgttcttaccaactgagctaagttcacgaggacagaccctgttcatttagcaataaggtattgaatttgcaagttaaaaatatatttgatattttgattaaaaaaagaatttattgatatgcaaaaagaacaaataaatattattattattattgcacttctattcaaatgctaagaaatgctctaaggagatttgttaagaagtttaaagcgaaaatttattctgaaattatgcattcaacgcattgaaataaaaaaaagtaattttttctaaatagttattttttttttcattttttaattcttaacaaatgtgttaaagacactttctttaaaaaaaatatcttaaaagataaaaagagaacataataaaataatatttatttttaaattattatataaataagtatatccaaaagcttgtacacaaacaagtctttcttatatattgttatctcaaacagatgttttgcggcttcgtaaggtttattgtcagccacaaaattcccattgtcttgtagtggggacagagtaaattgtttagctatgatttgaataagcggttcatgcaaacccgatatattgtgtatgtctttcatgatggcggggtcatatagttaatatatgaatcatacactttattaagtctggtcttggcaagtgcaacaagaccttttgcatagggcttcaaatttagagggtactcaaaatttaaaaaagaaagtttttttttttttttttttgtatatatgaagaaaatcagtcggtaaatgtcttttttttaggtaagagtttgaaatacaataattttgctatcatttatacattgtttgtaggtaaatatatattttttttataggtaatagtcatgtatgaactattgctcttacatttaactacaacgtagatgtttgtcaatataagtggtgttggattttttttaaacacattttaaacgaaaattatcaaaattataacgggacctccgaattatcggggacggccctgcattctataaatgagtctcatataaaataatgatgcaatatatataaaaaaatattaaaaaaagagtgttaacactactcttgttttactttgcgtctacaaatagtgtatttttctctattttttggtaccaagtatttttttatctatttactgtccccttaataaaaaagtcttggcggtcaaacaactcaatgattgcaaaatcaattagcatatcatggccttctaaatcttactcgattgatttaacgtttatgatgctacactgagaatgattgccccaagcacgtgcgcttcgatacattggcagtgtgtctagcaaaatttttgagggattctctatatttttaagcatcatgctaacgaatgtttaaatgatattgtttgaataaattttaattagaatttttttgagagacaaattaaaatagaaattttattttgaaaatattaaatataagttaaatatttgtcaaggcaataaataatattctttttatgcaaaaaaaaaaaccaaatatttaggtaacgacgacccaatagtttcgtaaagtttagaggtgatgatttatttttggggtctcacaaaagagtggacattggaatatgtttatgagatgaatttgacatgtttatgggagctaaaactatatggttgcaaccgattatgtcaattgataaaggagaagctttagaattactagcagctatgaaatgggtaagagaactagagtttaagaagattattgtttgcttagattcaaaagtagtatagtagactcgttcaacacacatgttcgagatgacgcggagcttggttccatcctagctaggtgtagagttaatttatctgatattcgtaacaactcttatgtcgatttttctaaaagagatgctaatatgattgctcataatcttgcaaaagcgaccatatataatgacaattctcatctctattttgatatatacgattgtattattcctttgaattttaatgaaatgaattagcacctttccagaagaaaaaaaaaaggtgtgaggttaatgacatttgtgtgcacatgtattcagttctattttttattttatttttaagataaattattagtattaattaataagttgaagggaaaaaattatgataatttttttaagagaaagcttatatttaaggactattttttaaataaagcttaacatttgtgtatagatgtactcacttcttccctaaaaaaaacagatgcactcacttgtaatttaaataaagcttatattttagaactattttttaaagaaaaattatattagaaacagaggaagtagctagcctcttatttatgccctaaaaatactatttgggatttgtggtctgtattattgcaagaagtggacataaatttggataactagctagtcacgtcgttagggaaatagtacaaatatcggctctagaacacaccaatattttcgttgttgcattgttggtagatctagaacacaccaatgttgcataattactagttaggagcagattgaataataaataaacacatccttttgaatcatatttccatttatgtttgtcctaccttcaaaaggcacgtcgaaattataattcgattatacacgtggatccttactttgatggaattaagcctagacatggctccctatgttttgtataatgtaacagcttattatataaacaaaatcttatctattcaaatttgagtgtgtttttttgtcaactcgacgtggcattattatacaatactattcatgattggtaatagttaggaatataaagatatccgtgtgatattatactatacgaaagtattaagatgagagccagttggaatgcaaaaagcagacaaagaaacttaagaatttgtcactagcaaactggagtttagctagctttacagattcacatggttttagcttatgaaaccctaaatatttttaaatggttttctataatgtacggtttagtacactactacttggttgtgttgtgctgttactttggacttgtttatgggcacttaagataattaggtagacatgtaaaaagctaaggttagaaccaacaatatccagctgggttggtattgaccttgtttatacctaaaaggaaaatcaaatgcatgttggtggctgctatagttacactctttagcaagaagtagaaatccccagttggatctgtgtcatagcttagtagttactgagtaggatacaatgattgccatgcacctgtacactgtagtttccgcacagaatcaaccaaagtgggcgcaaactgctgttgcctattccttttgtactggccaatactgaccattgggaatgggtttattcaatctttaccaatccattcatcagacactagtctactttttacttagttcggttttaaatataagaaaaattcgagtaaaaaataaatgtatttgaatcaaaatttaattttcgttgattcaattttatctcatactcttttcggtcatatttatagacaaaaaaaaaacattttaggttcgttgattacctaatgtatttgacttatatatagaccaaatacattagatattaaatggatctaaaattattattttttttgtttataaatgctatcgggtgaagtatatatttaagattggagtgagtaactctttttataggatttctaataattggataaggatgttttaataaaggagaatgttaaacggtggatattagttaagcaaccaaaccaattttattttataaaaaatagtgtaattattacttaatcaaaaatcaaaacttatatttttaaaacaaattttctatttatagtttccttaatcattgtcctgaggacattggttcaagaccctttaataaatgataaatatttacaattgaaatcaacaatattaatcatttcctcaatacctatgtaaaactcaaatgtgacacctaatatgagacaaaagtaataatttattactccccctgtctcattataaatgagtcatttgctcatttcacacatactccctccgtttcaaaataagtgtcgttttagccaaaaaaattgtttcaaaatgaatgtcactttcggtttccagtgcaatactaataactttttcttttcaattatacccttcaattaatattatgttacattacttccaaagtatttttttttctttaatgaaaaagaaaccaatagttgattaggataatttggtaaaattgctatgacatttgaccactttatctcaatccttaatatgtgtgtaattggctaaagcgacactcattttgaaacggagggagtatgaagaaaacatgtataagtgaaagagagagaaaaatggttttgactatctttgtcaagtattgatgcattattctttatcataaatgtaaagtagaatatattgaattgagagttgtgaaattaatattaattagagttataattggaaaataatcattagacataacacttttactaaactgcacttattttatatgaaaaactcaaacttaaagttgcattgaaaattgtgtgagaaaatggtttgagtatttattgagggaaaagttggaagaaaaaaaaattaaagttgtattggaaatgtaaagtgacatccattttaaaataattttttttagctaaagcgacactcattttgaaacggagaaagtgattaatattgtattgaaaagtgaaatggatcaattttttgggacaatattttttgcaaatgactcatttattatgggacggaggaatatttaaatttagagttaaatatatttttaaatctagttcacatatatagtttttattcaattttagttattttttgagaaagattaagtttaataataaataattggctaaattacatattttttagttcactttggtcctttaagtctttatttttttcattttggtcccttaaattacaaatgttatataatttagtcttttaaggttttttttttttttttttccgtttcaaatttatccgtcatgttattaacgtaggggaggggaagggaaggaaagggagaaaggatggaaaactttccccttgtttaggagttcaaaaaccaacaaggaaaggagatgaagggcttatgttataattttactattttaccttttttctcttaaaatcaatacattgtgttatactttgtaatttattcaaaacagtttatctcatgaaaaacaaattattacgatctctttttcaaaaacaacttatttattcaaaacagcttattacgacctctttttcaaaaacaacttatttatgcaaaacagcttaatacaatctctttttcaaaaacaacttattcaaaacatcttatttatctaaaccaacttattacgacctcttttcaaaaaaacagattattcaaaacaacttattacaatctattattcaaaaacaacttattcaaaacagcttatttatgcaaaaacaacttatttatccaaaacagcttctaacaatctctttttcaaaaacaacttattcaaaacaacttatttaggtaaaacagcttgttacgatctcctgttcaaagacaacttatttatgcaaaacaacttgttacgatctctttttcaaaaacaacttattcaaaatggcttatttatccaaaaaaagcttataacgacctcttttttaaaaaaacaacttattcaaaacagcttatttattcaaaataacttattacgatatcattttcgaaaacaacatatttatacaaaacaacttattccgacctcttttcaaaaaacagcttattcaaaacaacttatttatgcaaaacaacttattacgacctctttttcaaaaatagcttattcaaaaaaacttatttatccaaaacagcttattacgatctctttttaaaaacaatttattcaaaacagcttgtaatatgttgttttggataaataagctattttaaataagttatttttggaaaagaaatcgtattaagctgctttgcataaataagctgttttggaaaagaggtcataataagctgtttttcataaaaaagctgttttgcataaataagatgttttgaataagctgttttttgaaaagaggccgtaagaagttgttttgcgtaaataagctgttttgaataagttgtttttgaaaatgagtttgaaataagctgttttggataaataagttgttttgaataagctgtttttgaaaaagaggtcgtaataagctatttttctttaaaaaactgttttgaataagctgttttttgaaaagaggttgcaaaaagttgtttggcatagataagatgttttgaataagctgttttttggaaaagaggtcgtaataagctgttttgcataaataagctgttttgaataagttgtttgtgaaaatgaggtcgtaataagctgttttggataaataagctgttttgaataagctgtttttgaaaaagaggtcgtaataagctgtttttcataaaaaagctgttttgaataagctgttttttgaaaagaggttgcaataagttgtttgccatagataagatgttttgaataagctgtttttttttaaaaagaggtcgtaataagctgtttttaaaaaagttgttttgaataagctgttttttgaaaagaggttgcaataagttgtttgccatagataagatgttttgaataagctggttttttttttgaaaaagaggtcgtaataagcttttttcataaaaaagctgttttgaataagttgttttttgaaaagaggttgcaataagctgtttgccatagataagatgttttgaataagctgtttttttttttttttttgaaaaagaggtcttaataagctgttttgaataagcggtttttgaaaatgaggtcgtaataagctgttttggataaataaggtgttttgaataggctgtttttgaaaaagatgtcgtaataagttgttttgcataaataagctgttttgaataagttgtttttgaaaaagagatcgtattaagctgtttttgcataaataagttgttttgaataaactgattattttaaaagaggtcgtaataagctggtttgaataaataagctgttttgaataagtcatttttgaaaaagaggtcgtaataagctgttttgcataaataagctgttttgaataagttgtttctgaaaaagaggtcgtaataaactgtttttaataaataagctgttttgaataagctggttttttgaaaaagagatcgtaataagctgttttgcataaataagctgtttttttaaaaagaggtcgtaataaactattttgcataaataagctattttgaataagttgttttttaaaagaggtcgtaataagctgttttgaataagctgtatttgaaaatgaggtcgtaataagttgttttgtataaataagttgttttgaataagcagtttttgaaaataaggtcataataagttgttttgtataaataagttgttttgaataagcggtttttgaaaatgaggtcgtaataaggtgttttgtattaataagttgttttgaattagcgggttttgaaaatagggtcgtaatgagctgttttgtataaataaaagttgttttgaataagttgtttttgcaaaatattgtaataattcagtaatgtctaaatttgaaattttgaattattatgagggtaaaattgtcaatttgtatgtttaaccccctaaaatcctcaatttgggggaactttaaaattggacaaatgaagcccttcaaaaccccccaaaacctttcccttatttttttaaaactcgcagacaagggtttaccattccataagtctttccttcccctcccctcccctccaaaacccaactcgcaaacaaagcctaagttacaaatattaagacatttgtatccttaataagaatgactaaaagtttaaaatgtttgatgttgataacgtaaaagatcaaaatatttaatgtttataagttaagtgagagaaacgaaatgatttttttttttaaaggactaatatatctaacgtattttaaagtaccaaaatttaagggcaaaaaaaacttaaaggacaaaagtaaaacctacaattaaattaagtaacaatttagcctaaataatttgagtgcaaagaagatatattaagctataggattatgggtggatctggactaacagtattaatggggcaattttttatcaaataattaaataatactaaatgtaataagaagttatactaaaaatatatgtcacaattccaaattgcgacataccccctatgtcacaagacccaattgcgacctacccccattctcaaagtttgcatttattttgtccttattgtatgtcacaagtgggacttgtgacatatttatttatcattttttctattaatttaatagaattagttttaaaaatttaaaaaaattgaaataaatattactaggaaaaaatctattaaattactaggaaaaaatcggaaaaaatatttatttcaattatttttaaaaaaatttaaaactaaatctattaaattactaggaaaaaatcggaagaaaaaataaaattaaacatgtcacatacagtaaggacaaaataaatgcaaactttgagaatggagggtaggtcgcaattgggtcttgtgacatagggggtatgtcgcaagttggaattgtgacatagggtatgtctcaagtccaacttgtgacatatgggtcaactctctaaaagtatggtagttttgggacaaattttatgatacatccaatatatttgagtgtaccggtacacctattctttaaattaatagttaaataagttgttttttgaagaaaaatattatttttttatcatttataattataataactaaatcttattcatcaaaaatgtcaacaaaataaaattattattttttgaatttttatcactcataatcgagaacattcattattttttatgatagtatgtaaaaaagaaaattactataattcttataaacaatgaaatgatgttttttcttatgagatgatgttctataaaatataaattttgacaaataactatttattacataaaaaatgattgttaatttataaaattatgacgtacacctcacaaagtgagtgtacagtagaagttagtatttttgtttcaactagggcattttttgatttttggtttcatgggcataaaaaaataaaaaaataaaaattcggcccttgaagaggttcgcccctgcataggatccgaattcaaaatggattgacccacatttacactgtgtttctttaaaccaaactttattgggttcaaagatagcacttgttttccctttcttgttcacatacaccacaagacatagtgaaacacaagtggtgcaacgacatacgcacgcaatgcatgtttgatattacggtgattttatttaaatcaaggcgattcattacaatctggcaaacttacggtgataacaaaaatgcacttagttatagaaagtgtgattcattttgatagtaaatttttggcttaattgcacttttggacccctatcttttcaaaagttgcggttatggacccctaactaatttaaatacaaaacagccccctatgttttgtttttttggcagttttggacccccagtcgattgttgactcggtcaacgctgacgtggcaccctaagtgaggtgccacgtgtcaaattttttttttttttttttgccttgggggtccaaaactgccaaagaatcaaaacatagggggctgttttgtatttaaattagttaggggtccataaccacaacttttggaaagataggggtccaaaagtgcaattaagcctaaattttttactttatgcaactatttgttttgatagatatatcttttttattgagaaatgatacttgtataaccattttttataacttttgtgacaacttttcctctgatacttatattattctttactttatttctctattgttttggtttttgtgcaaatgcctactttttttttgtaaattttagttgttccataagttgtcaaccaaatgattgttcaaataacactcctcttttttattttagtatagagagacttaagatatgtaattttcttatgttactcatcaatcattttagaggaacacaattatttggtgatgagggtgagtaaaattgaagtatatggctttgttttaacaaaaaggtatatgtctataagttgttattattaactatagaaaatcttaacacattatcaattattcatcttaggattaacggaaggaacacgtttacataattacatagttaaccattttagtttgtcaagtccaaattcacatcactgataaatatatgctatacaagacactattcaaataaccattccaatcaatattttggttggtctatacataggatccaaccatgctaaaagtgagagatgccacctttggaggatatattgtaagactccatcttggaatgagacatgaactcttgatggctgtggacattacttaagtcgttaattggtttatcattacctaacatgatttgatgcaacaataaacggtggatgtagtaactatcacaatcatgcattcaaattttatatatgggaagagaaaggataatcacaaatgctacatagttcatctaatataatatttttgaagacaaatttgttatgcgttagtggtgaggaaaatttgaacgttgcaccttttatgactcttaacttaactattgtattccacactcaactaccaaactactcttatgactctaaactccatgtaattcctcctcttttagattttggcccgattcattcttcacgaaagctatgatgtgttacacatgatttaaatgatcatgttaataagtgtattaagaacacttcacacttgttaagaaatcaatttcattaaaaattgtacaatcaatttttaaaaagcctaaaagtgttatttttagcgattttttttgccttctttaacaaatactacctagaaacaattgttagcatttttctaaattaaatgaatttgtttggaggttaccaatattgacacgtcatttgagcataaagttgcaatatttattttgatcattttccattatgagatacagtgttcattcaaagctaaatatttttagtattctcttcggacaccaaatatacaaaggaaaaattaggagtatatgttagaaaaatatttaaatagttaaaaaaaaaaaaattgattgaagaaatttttgggacgagtcatagattaggtcgctctttttaagaggttttgcagcactgcccaaaactgtggagcagattatcaaccacgacgtccctaaaataaaatagctcaaatacaaatgtattgtagtcctactgcacaataagatccattgtagaaatacaacatcaatatggtattcaaaccatatgaatatgacactatcactctatctttcgaaagggacaatttaacagtagagactttttttaaaggaataaaaagaaatagggaaaagttggcccggaatggcgttctgcagaaaaggggagaagagagaactcgttgattgttaagttttggcgtgtctagagagtgaggttgaacactccttttatagggcaaggatccaagatcgcttacaaaacggatgactcataccatttgaccgttcaagagacggacggtccagactatgcagagcacatgcattggcgcgtgttggacgcatgctgatgtgacgatgacatgtactaaaaccgaaaaaattccaaacaattttttaattaattcaaggtttcgagtcaatagaaaagattacaccttatagtccatgcatcttcatcatcttgttgattgcatcatcttcttacaaaattgagtatcttttggggcacatccgaaccccaagagtcctacctccactacataaacatttatgttgtgtgaagtctatcctatatgaaacttccactatgtaaacacttgcgcgacttttatgaattttttaaatcacacacagagacacacttgtgttccaataatcgcttatgaccaattcaaaatatgaaataagtaacataagaaatatttcagaagaccaacctgatcatcggatttttattttagtttacatgaatattacaagtgcttgcttgccgtatttctttcttcataaaagaccggattgggggacaatatgcatggaactatacattattcatcgagcaagttgttttttgtctagaaaacccgaacaaagttttttattaaacctcaaaacatcacaagtacaagatgtaccaatgttgtagggatttatgactttttccatataccagcgacttatatttaaaaaccaatacaaaatccagaaatacaccaacagaataaaccgttatgcaaattgtgttaaaagtaaccatatatagaagagattaacaattacaacatatcgtatatcatagaatgtattttcataaaaaagaaaaaagacagattacatgtaacgtgtataggtggttatgtacattgtgcaatttcaaggctataagtatacaaattacttatgaattatgatcgtgagtatttaaatggccggtgatgcaaatcatcactctactatgtgactaggtaaggtgggactaccacgggcacaagtatttctgtaatagaatcatatacattagccgatttatacaacatagcgacgaagataatccagtcgagctgaatgcttgagcttcataagagccttgacttcgtgctttctcaccatttccctagagatgttcaagtttgaggcaatttctcccaaagttctgtcacccttaccatcaagtccaaacctctgtctgattaccaagttttccttaggcttcagggaatcaagctagaaaacaacaacacatatctaacattagttgcaaagggggacaaatgaccatggaaatatgatatatttaattatatatattactaacaaattagtatgacctaaaccacacaatttaaaaagtagttcacatctaattaatgattgggtcacaattgtctataaactatgttacatcatggaagggcacaaaataggatttaatgataccgttggaaattccgccttaaatccttattagcagtccacccgaagcagccttaattgcatactccaacatcgtcattgtgtgttgggtgtggttttagtcccacgttgcctcgggatatgactgaaatagtcattatggtttccagagtcctcacattacaagttaggtttgtggggttgaagcctaagcccaaaaattttgtgatatgttttggaggactaagcctatatgttgacatgtttgcgattttttaaaaaaatattgaaagaatcacacaatagatgatcatataatatttcaatcaccattttagttgattttagaaacattcaataatttagaaatgaaaaataagtcttcccctctctttccctccaaaatccaacttcaaaacatatagccttaagagaaacaatgtttagtttttgacaagatgtgatcattacacttgttcgaacttggacaagatatgatcattacacttgtttgaacatatagcaacaacaaatacctattgatatttcacaaatttaacagattatttttgtataaaatccaataatgttcactgttcacaataataaaattgaataaaatgacgtattgtaatacaatactagtatcaaatcaaacagagacataaaaggttagagccattaccacatcatcaagagcaagccttagtagagcaggttgcctcctgttatcgccatcaacaccaccatcatcaacgaccccattgataaactcttcttgcgtggttagatgtcttgaatgcagtgaaagaaggggttttgatgccttcattacatcacggtatctttcaggggatacatgaactttttctattatttcttcctccgttggtgacctctgaagctgaaatgataactcaatcttagctcttcggatctctgctctaacctgcacaaaattaaaagataccagacacacctgaattaatcaatcaagctcattttttatttcttaagtttcttaaaatccatattttctttgaatatcctaggcttaagtcttgtatagttctaccaattattggccaaagaaaatattgttggatgacatacagataagttagcccttacaagtagctgagactgaaaatggagtaggtttctgctaacatgaaagatatataaaacaagagccctgctatttctagcgaagaaaattgttccgaagtatcacaaatcgactttcactgttaaatcttcaatttattacaatacatataggtggataagatatgaataaataattcctactgcagttatttttacatcatcgtgatgttgtcgtaaacagttttctcgggacaaatagcatttctcataaaacaattgaagcatatgctgctaaaactaaaacaataatcagcatgtgtggtaagaagaagaatacataccgattcaagtccaaagggaacacgtgagaagcttgcgagggtcatggaacggatgatagcatgtcttatccaaaacagactgtaggttgaaagccgaaatctccggtttggctcaaaacgatcaattgatgttataagtcctttaactccagcctgacaaagatcctgaaaccttgggctattggcgaaatctgaaaaatatctgttgatcacgaacaagacaagccggagattgtgctgcaaaagatcatatgaccaccatttgtcaattattgatataacttgctcattccaaacaatatcactaaaatgagaggggcaaaatttaaagattacaaagtcatcagaaatttctacaaaataggatctattcccataaccatgtaaactcaacttcatgatttaactattattataatgtaactactattgctgtgaatattggtcaattgagtttctccatcgaagttagaatgagatagtgttcccacgaattcgcctaatacgactctagatactctattgaggactaagtcagttttcaagaatagacaatgaaaatgactgttactcagtcctaaatccctatcataagttgagttgactagtagcagatgaactcattaattagatgaatagttcttgtttagtcagaggttcgcccgagagcttaggagagtatgcaacccctcagaccctcagccatgaccatgaagtgaatgggactcacaattggcccacaaatttgggagggtacagacaggatggataacgacacatattgaatagttaatctttaagttaaaactagtagaaagccaagctgtaaaagaattgaacaattttaattacctttattagcttatttcttgcagctcgaccaacctctattgctttctttacttgagtagtgtgcatgtttgttgcgtcggctatttcatcctctgtgggctctctttctagctccttttgtaaatcatctttcacttgaagaagtgcctgaaaattgacaaatatatcttaatatcagaaataaaatcaaattctgagtttttgcctaacatcattgaccactatattggaaatattattgacatggtatcaaaaagccttgaatgccttgttcatcaagtcgctagaagtggactaattgtgagggttttaggttttcaggaggttacaacttacaagttccaagtgccatcattaacaatatgaaaaaaaaataaaaaagaaaaaatgaatgaccaatatggtcaagatgtggattcttgacgccctcattcttattatatgcatgaatttcagcatagattataagacctttgcttgatttgtccttcaagttcagacctcggagggagtaaaaccaaagaaatatttatgaaccttgacttgccaacttaagccatcgggttttaaaccattaagttgaaagctttcttgcttctcagcaatgaaaagatctaaactactataagaagagtaaaaccaaagaaagtgtggtccagtgatgaaattatagtaataagctgctcaccttcattggttgcatcaacttgaacaaaaatgcatgctccgaagaaggaagaactggaggtattttcatttttttccagtccagactgaccaaatcagctggtactgagtattcccttagaagttcgtcaatcttctcaactctactcctgggatttctttttttccgagtaggaatgacatcttcactattttcgctcgtttttaacgcaatcctctcatcaagattcatccgtttggctttcgttttctggtttctgaccaccctatcactgtttgaatcctctttacttacatcaccaatcttcttaccccttcgagagactcttttgatcttacgttctatataatctgcatcacatatatcggttgtcgggctaagtttgtatatattttcaagtatggcagcagcttcattataatccacatccaatgaagatggaaaagtttcctcagtgcagacggctcttggtttcttaggtagtttattcgtttttgctatccttttcttgtgcgtcttggctggtttaacttgcgtaggaattttctcttgagtcgcaaccaacgctgtgtcattttgtttatctcctttaaatgctaccgttaacggtctcttcaataccggatggtgagttgaaaactttgcattcaatcctagtggagtccgagcagctgaactagaaacagtcacaactcccataccaagtttgccgaatcagtgtttagaaagaaattcaaatgacagtttctcaatgccaagttcctgcaacagcacaatgccattcaattaccaaataactcaagtacataactattgccattcaatcccttgattaatcattcaatttagcttcaaatattaataccaaaacaataatatatggagaacaagttaatatattactttactagctaggcacaaataccattcatgcatcagtaagattcttcaatgttcaaacccctatcacatacaattttgtaggagagatcaacaatctccctaaccaaataagaaatttacattttaaattcatagttatctagtatttttataacaatattcatttcagtgtttccttctatatatagtaactggtagcacctaaacaatgcacatgcaaacactagaccaaattagaaaggaaaaataattaatctataatccatagcttactttcaaattcaaattatcgattgcttactcaataatttattgatttgatatcttctactatcaattgcttatttcaaattacaagtttcacaaacaacaccattgaattaagctaccatttttctctattcactaataatcagtgaaaataaatcaaattaaagtaatcaaaatcaaatgatcaacttaaagaaacacatattgaaagaaaaacaatgaaaaatagaattgtacctttgatctctgaatggaagaatctagacaaagaatctaatggagaatgaaagagaaattatatgtgtttgaggttctagtatttaactcaaattcgaaaattacggtaaccacaatttatgtctttgaaaaatcaacggttaagaactaatgtcaatgatatctacggtgaatgaaaagaacacgtgagctgtgatttggaacacaagtgctgacgtagcaatgttagaaagaagatagtgttgtcgtgtcgtttttggagtggaggagctgatattttgcatgaagaaaaaacaaatgaaaattgtggatcataactttaacacgtggctgatgaaaaatatttcatttctttttttctttttttttttgtgacacaaaaattatataagaggtgcaattttggatacgtagaacattacgaaccatgatatatttttatttttgttgttgacgaaacgaataatgatctgttgtccacgttacttctgtccatccatggccttttccttttccaaaacacaattttcgcaattaaaaaaaaatgttcgtgataatttttttatgacattttagtttcttttttaattatcaaaattattataaaaaaaaagtattttttttaaagatataaaaaattagttagatcgtgtgagattagatgattaacttaaccctttaaattgtatcttttcctatcacatcattatctctttttctcttaagatgtatttactcgtacgaaatgtacatcaaacatttttcttaaattaatgtatttcatccgtcaaaagaaaactaatgtctttcaataaattttagtactattgaattatgaaacctagttttgacaaatgtttatataatttaaattggatcaactccttcactaatatctacatcttgataaaagttttagaattcaaccatagatcagtagatacaaggtataacatatcagtaacaaggaaggaagaagaatttgtgtaccttgaattatgttgatgaaggataactgccatgagaggaatgactaccctcattccgtctaggtttgcaccatgctggtcagaatgtttaaccgtctaatgggatgacgtttaaatagataaacggctgagggcagggacctctcattaaacttagctaaatggttcaacctatcatggtccatttagaaagaatagcacaatcatacatattcatcaactaattagtgcttaacacaatagaccataatttatattataacattttataataataattgattattgtcaatccataattgattaattaaataattaatccaacacatctatctcctaattctctatctatttcttaattccatctcgttcttgataattttattaattttaatgaaaagagagtgagattaagagagatggagagttaagagagatgtagagaaatagtgaatgaaatgatccaaatcaaaaaatgctagaagcctaaaatactttccttccaataaatgcacatctatttttttaacggcataatttgcttattttggataggctaattaaagttgatttaagggccgacctaacacatttgaaggccttaggttaattttttagggtatgttttgttgacgagttttaaatttcaagtagcaacctgctattagatagtttaaatgagagagcattttggttatctgtttaacttctttttcaaattcagaaatttcaaaacacaaatcttaaaatccatatatccatcacgctatttgatgcataatgctccttgaattttgtaattcataagcaaaatgcttcacaaaatttatatatctcgtaagtaaaatttacttcaaatgatgtgtcatcaatttggacaaatcaaatcatcggttaatgtgatacattaacactcataataaagttacttgagagatatactaatattttaactgacgttgtttaatttaagggaacaatttagaattgtgtaaatcttgaatctcaaattatcaaacgctcacgacttcatgcacttaatttgatagtttattcaaatcaaaattaacatctttctaattcaatggaactgcaaatgtataaaacttagaaaatctggaatgcaagaaatgtagaacattaaaaatgaaattctaccttgctatacattgattaagaacactacacttttagacaataataaagttaagtacaatttttgtaaaaaaaaaaaagaaaaaaaagaaattaagttcaatttttacaatccctcaaaaaaagtacaacttttacaacagcaaaaagggatagttgtgttccgagctatattatgagttgctacaaattacctgaaggttgttgtaatgagattgaaggtttattgtcaaaattttggtggggagcaaaagaaggagaacggaaaattcattggatgagttgggagcgattgtccaaggctaagaccaaaggcgggatgggttttcgaggttttagtgatttcaacaaagcgcttcttggaaaacattgttggaggctcctgaccggcgaagatacgctaatggggaaagtctttaaaagtcggtatcacccaaggggaagttttttggaggccaagatgggtttttctcctagctatgcttggaggagtatcatgagtgctagagatgtaattgaaaaaggtagcaaatggcaaattggaaatggagagaaagtcagaatttggcatgacaactggcttccaaacagaggcaattcaagagtgcagagtcaatctacaatactccaacaagatgcatatgtttgcgctcttattgatcaagacaccaagcagtggaatagagatttgatcttctccgttttcaatcattttgagtcaaggctcattgttaacattcctttatcttgtagacttctagaagatactttgatttggtctggagaaaagcatgggaattactccttgcgttcagcttatcacttgttaggcgaggaaagaaagaacgttctaccgggatcatcacacgatgcctatgagaagctgtggaaagaaatttggcgtgtaaatctcccaaatagagttaagaactttatctggaggttgtcacaaaacatcctacccaccagaggaaacttgtttaaaaaaggggttaaaattgagcctttatgtccgatgtgcaattctgaaactgaaacagctcaccacctcttcatggaatgcaattttgctaagttagtttggttctcatctagccttggcatccatgttctgtaacagcccgttttttagctaggtttattttaattacttttattatgtgtttgtgtgtgattatttgtgcttctgtatatttaattgtcatcgggtgcatttacgtgggttttcgtattaggggggtattttggtaattttgtgaggatgggtaaaattataattttagtgggaattgcttttagtaattagtgagaatggttatttcattaagttactagagagagtcgagattttaccgttagtgacactttaccgttattaattaaaatatcgtttggagtgtagtaatattttggtttgaatagaaatgggttaagcccactagaaactaagttaagcccattagtagcgataacactagggttgtgttaggagaaccaattcattcatttcacaaacatttctagagagaggtagagagagaaagaggtgaagagaagagctttaggaatcaagtgggtgacttaggagctgaattgaagcaaggattagggttaatcttcttcaaaggtaagggggttagttattatcacaatcatgtaatttttgcatctactcatgttgtatgaaaatgggttgatgaacaattcatgctaaattcgtgctcttgctgtgatgttatgtttgtatgcatgaattgatgttagttgtatgattgttggtggaattacatgttcatatatgcaaaaatgataagttatgaatattgtgctcaattggtgaatttctcctaagttgttgttaagttgagatgtgatgcttgttcaaatgatgttatgaatgttatttgataatatgattaatgaataattgcttgggtttgcatattcatggattgatgatgagaatttgagttgtgttggtgttttggtgaaaatgaagagttagctcaaatgtcaagtgttttaaaggttgattgtgcctttatgagtctttttaatcatagtgacctgtaaacatgttctggaaacatattttgagatttgggaatcaaattggggaattttgagtgaaaggggttccaaacccgtaaaatttctgcaaacctgtgaaggttcacttagaggttcgcttaagcgacctggtaagcgaacattcatagtatttttctgggttcagttcgcttaagcgaactgtgagcgaacgagtgagcgaagatttctggttgttactggaactcgttcgcttaagcgaacatgtcgtcgcttaagcgaactggtgagcgaccagtcagcgaccagaaagcgaacaaggcgagttgctactgtaacttgttcgcttaagcgaccctctgggtcgcttaagcgaacagcttcagttccaaccaccttgatctttcgttccggtctttggggaccaaatccgagttttcttaaatgatgttttaaacatgttaaaccactgttaattccctaaagcctgctggaacgatgagtgttcgcatatacttgggatttttgaaatgagtcttaacttgtgagattttgagagttccaaaccttgtcgaaaacaaattttgtaatccaatgaggcttgcaagtagacctacagctcatatagacttaggtgatgcttgcaagggtggccaataccattatcaaagtgaaatgatattttgagtgggaaatgaaaggttgtgaaaacgggactccttgatgaacttaagttgtgcttggtcttgtatgatagtctgaagacgacttaacttcatgtagacattattggataagattggttaatagtgttcgacttgttctagttgtttcgttccgagatagtgtggtgaattattcatgtgataagtgaattgtgtgaaagatattgttgattgttgataatcaagttgtctgtgtgatgatgaatactatgatttaactgtgtgtgggtatgttctcttggtaatgcaatgttgtggagataatcaatataattgggtgttgtcctatgtattgagttgagattgagaaatgttgtcgcattatcgagtcattacacatgtccatgcatcatagtcgttgttgctgtaaaggggatgactcttttacttcgagattattgtaaggcaggtgtgagcccttacaatcgatgtgcaagtggcatcgaaaggtgacgaccttgttgagatttggtaccgcatgcatttatgtgtccataagtgcatatcatagcatgagtcctatgtgaattgggtgattggtgatgttttgagatgaatgaatgtcgataatgattgtctatgattgatgttgtgaatgaatatttatgattggataattattcatgtgattgatatatgtggatacaaactatcaagttgtggtataagtgtttatgcatggctaatattattcaagtacatgatattatttgatttgattattatctggattatgataatgtaatgcttacccccagtggttttaaccgcctacttgcctgtatgggtgagtagacgttgtgcaggagtagtctcagtgagtttttgcttgggatatcgggagcttcctccgatatcggtgtcgtgtcggctctgatctaggcttgtcgtgtcggtctagattaggttgtttatatttttatttggattattattttgttgttgactacccgtatgtttgggttttgagatttatctttgggatatgatttatttgctcatggcatgtatatattcgatcactctgatttatattccgctgtaactgttgagaattacatacatgtctatcggtttttgaattttgaataagacgtaatctctatttcttgaataaatgtattattcgcatgtttaattgctttaatagaaataggagcgttacatgtcccgttacactcctctcttagtagctggcttttaaattggttagaaaagaaagataaattaggctcacagttattttgcactattttgtggaaaatgtggttttataggaatcaaatggtgttcaaaatggttaatacctttccccctgatgttgctactgctgcacttgattttgttgttgattttaatcaaacagtacctgctaagaaatccaaggggcagcaacccattgctgctgctcctagtcctgttcagaatgctcatattatccaggttgatgcaggttgttttccggagggatacaccacttatggctgcgtgtttaaggctgctccagataacatttttttctcagcgtgcaagaaagaggagctgataacagatcctgtcatggcagaaactttagccattcgttggtgtctcaatttagctaaggaaagaggccttcaggacatcattatccaatctgatgctcttgctgttgttgagtgttttagagggtcaaattcacttgcttgtattgctttgataattctagattgtaaggtacttatgaatgaattcaatagtgtgtctattaattatgtttctagagatctaaatgcattagcacataggcttgttggctatactatgcaagttggttgtaagtcatggaatggatatgcttttcgtgttattgcaattcctactatctgtaacacttctattatctaatgaagatgtttgaatttaaaaaaaaagggatagttgtgaagagaaagacatacacaataaattaataatataacattaagaacatgttatattgtaatttaggtaaatctcacatgtggccaaaacataaacatgaaaatttattgttatatttcagaattgaaaatattctcagcatcaattggcaatcataagctaatttattttttggatgaaagaattcttaattagatatttgtcacaagaccaaactccatattacaataactcattgtcctagaacctggaatggtaacaccaaaaataaaaaattgcggtcttgaattaattcaatttctttttcaaataattgacttggtccttatttcgaatagctacatacaggctcaagggtcaaagaagattctacccgccattttttacatattccacacgtttaggttgaattgacagaaccgtggatcatgggttattttttctcagcccacacttgcttcctaagcagcccattaaatttccagttataccaaactttttcaatcttattagtttctcacgtcttatttaaattgtaaaattcaaaatatttaatgtgtttttgagagttttatggggtgttaatgctgttgggattttataatccaaactgcatatgacgcatgagaagtaaggagtctaaatcctatttctatcaattttggttgcttcttagctgcttctacaaataaaattcagagaagattcccaaagacaacaaaattcctacattgtgagagtgtttttttcttccgtttttctagatagctttgcttttctttttgacgacaggagtaatgtttccactcttgccaacattaacttaagacttaagttgaattggccttattctatttctagatgacttttttggacacaatcgtatttatatatttgaatctttcaaaaggaaggacggtgaaacttaaagctagttcactttattgagaactttcctttcatggttttagagccaaaatcttctccatttttaaaaagaaatgatgagttcagatattatagttttgtgtgtatggatcatataaatgttttaataaatctcgcatgctttagaaatgtgtgatatttatgcaaaaattaatgtgtcatattatacacacaaaattatatttccgtcattttaaaataaatgtcattttagaaattcaatgataaaattaacttatgagtttgaatggagatgatgaacttatgaaccccaatataattttttaatccagattttttttaattttaaaattatattattttaatattatttaaacctattttttaattaaaaaaaataatgatatggatattggttaatgacatgaagtcaatttaatccaagtaaagtgtgccacatcattgccacatcttaaaaaatggtggggatcgaaaaaatctcaaagattgtatcataagaggaccaaaaatctggttttagaaatacgggactaaatgtcaaagttttacaaaataagaaaaccaaaaatcatttaagcctaaaaaaacacatcgtggataagttgctaatagctactccctccgtcccaaattgtatgacgttttggccatttcacacgtattaagaaatgtaattaatattgtgtggggaagagaaattatgagttgttttacaaaattatccttaataaattgtatggaaaagataaatgaaataattgaaagaagatggagtaattaatagttaaggatataataggaaaaataacattaatattttattggtattgtaaaacaacatataatttgggacaaattttttttccaaagggacatacaatttgggacggagggagtaccaaataagcatacagattgaatttatagtgtttatgaaaattagcatttgaattaatcgatctgtatgaaataacataaatgtatatctttaattaatatttattatttttcaattacgataataagtgtaaaattgagagagaaaaatgacaagaacactacttgaagttgcgaattatcaaaaattgttataacctcataaataaaatgatataagctcttgataaaaattgttgcaatcacatctattttgctcatacaagcatttaagttataagcttaaaagttaatcttaccaaatagagcccagaattatttgaatatatgcacatctagtgtttatagtatggtggggaaaattggcatagagaaagtaaaggaacacattcacaccatacaaaaacagaatcgaattgaactgttgaattgaaccgaactaaataaaaataaaaaaactgaattattactgacaattttgaaattgaactgaaacagttcaattcagtttaaaacagttcagctcgattcaaaacagtttggttcggttcaataactaaaattcgattttattttatttttatattttttcaaagataccaataataacagttcaaaatacaaacaattcgattcagttcaattattttaaatttaacaaacagttcgattcagttcagttttcatcccgaaccgaaccatgcacacctcggtctaagagggagctatagtataaaattggcttattagattgtttggtcccttatttaatttcatgttttcattttggtctcacatttaataaaaatggcgttttgatccctcacctttttctccgtttgccaaataaatctcaaccgttaagtttaataaaaatgatgtttatggtggatcatctttaagagtggtacaccatagatcctattaattattttaatttcgaccgtttgatttttttttaaaaagagaaccattgaattaagcaggtctattttatcttacgatgtaccaccaacacctaatttttttcttttcttcatcttcatcaatcatattcatacaaacatactcagaaaaataaattaaaacaagaaaccagaaaaaagaaaaatatcatcatcaacactataatcatcctttctctctaaaaaaaacatggatctgtggtggttcaaggtcgcacgcggtgggaacaatgggtttaacggcggcgatgggttgaacggcgacgacatgaacggcggtgatggttttttagccgcggtgacactttttccccttcctgcttcatgaatcacatgcttttcatgtggttcttggattacgtttttttagtttgagaacatatggagatgatgatgagaatggatagattttggtttgattttgtgtttgttgatgttgtacgaattatttgatatgagaagagattaatctgaatttgtttggatttcttgttgtttgttgttgaacctgtgttgattgttgttgctattatttgcccaaattttcctttgttgttgctcgttggagaagaacaggaaaagaaattggaatttttaatttggcattatgggtattttaggtatttcacttatttaccattattttatgaagatcatgaataagaaggtgaagatctaatggtccattttatgataaatagatcgaatggttaaaattaacaaaattaataaggtctagaatagaccacttttaaggttgatccaccatagatatttagagttaaagttaacacttgggatttaattgacaaacggagaaaaagatgacggaccaaaatgccatttttaataaatgtgggaccaaaatgaaaatatgaaattaaataagggaccaaacgatctaataagcctataaaattagtgacatgttgataaataaataaaggcttaaatgctcttttggtcccttaactatttaattggtatcgctttggtctcttaactaaaaaaaagattctttgaggattttaagtttttttttagtctcgttttggtcctttctgttaggtttccgttagggttttaaaaaaaagttaacttctggacacgtgtcaccttgccattggctctgagttttttttttttttttaaattattattcttttaaaatatatatatattttttaaaaaaaattccaaagtcaatgacaacgtgacacgtgtcccagagttaacacgtgtcaccttgtcattggttctaggaatttttttacaaaaaaataatatatatatatttaaaaaaaattaatttttttttataaaaaaataaatctcagagccaatgacaaggtgacacgtgtccacctttaacgtttttttattaaaactaacggaaacctaacagaagggaccaaaacgagactaaaaaaaaacttaaaatcctcaaacaatcttttttttagttaaggaaccaaagcgataccaattaaatagttaagggagcaaaagagcatttaagccataaataaattaacgtgcatgactaaatgcaagaataaataaacatctgttgaatagatatgtctttttgagagatgagatcatgaaaacaacatcacgttgtcactcgcatgattcacggcagtagcagtttatctctctgttttttagtttagattttcgataaatatatgtataatatgtgtctaagtacatttaagtaagataatcacttgataaacaagttcatgttagattagagagagttgaaatttggacgtatatcatgagtgacggaagcagacgtggaagggcagcgtcacaaccttgtcacaaacgttagaaccaatcgaaacgacgcggaaaaagcttcgaagattccatgtcttttctctttgactttttttcttcacgttactttactgcttctaattcaagatctaaatcgtccaatttttaatttgtttaggcaattataggaataggaaatagtaacaatcatttcattttggggaagggtcaatgagaaacaaggttggttccgcgggtagaaagggtcaacaattagacctctctccaatatactactcactcactcaccatttcaatcctatgaccaaagaccaaagaaaattcattcactcgtcgagccacttttttgaagtcaaacttttctttccttttttgtttcctttcttttcccactcttttcttcccttcaaaacacacaccccctttatatcccatccccataactcaccttcattaccaaatcccaacacctatgttttagttttagccattttttcattaatttttttttaaactctattttcagaactaatcattctcaatctacatgggagattcaaagaacttaatagatgagctactacatggattggagttggcaagacagcttcaaatctatctcaacgtgtcttcttcgtccaatgaaacacgtgagattttgatccagaaaattatatccacgtttgaaaaggcacttgaaatggttaaccgtaaaagacatgttaatatgggtgagtcttcaaagcaacaatacccctcagcctcaggaacacttgccatccgaatatcagattcaccacctttgagctgtagtccacgaagtgaagactccgacagagattttaaccgtgatcacaatgcttctagaaaaaggtatgtaaatttgttagctactctactattaattaaacacattagatcgtatccacgtaagtttagctcagttggtagagacaaggttgatttgcttctttgtatgtattctactaaacatgtgaccttaccctagatatatatatatatttattttaggaacactctaccaattagatggacaaaacatattcgagttgaaccaggaatggcaatggaaggtcctcttgatgatgggtatagttggagaaaatatggtcagaaagacatccttggagccatgcatccaaggtatataatttctgaatttaatgttatatatctattgatatagttttgttacataaattttggatgtgtgtatgcagaggctattacagatgcactcatagaaacgttctaggatgtttggcaacaaagcaagtacaaagatctgatgaagacccaacaatcttcgaaatcacataccgaggaaaccacacatgcacaattgcttccaatgtggttggtccaacattaaataatccattccaaacacaagaaacaaatattgttaacacaaaccctcaaagccttgatcaacaaaaaccaccaaatgaacaacttttgaacaacctacgaacaggtctaagagttcaaactgagaacctagatttccaaaaccaatcatttgttccatttggaaaccatgtacttgaaagtagctttgctgaaaacttcaattctccttcatatgtttcccctgcaaattcaggaataagtcacttctcgatgtctccaactccaagtgtgttcccaaatatggcaagtgagattattccaccagctacttctgctgcaaacacaccaacggcttcaatggagtttccatttgatcaatttgaatttgatggccaaaacttcaccttccacaactcacgatttttctcttaaatacactaaactatgacaagaagctaatgaatattttgataatattttttttttttaggagatttgataataatgtgttagaactagatgttttgtatcactaagactctgcaaaatcaagaggttgaatacatttgtcctagctactcatatagtagggatatggaagtgcaattttacaattgaattatcattgaaaattagagttatgaaaagaaattggtttctaattttaatgcttagtgacataattagaaacacatgctattttcattaattttcgatgataattcaattttttttagcttgacttactagtgcttccatatgtgcaacaatgtaaagtacgcgttgaaatggtcgttttattcaagttgaaaagaagggggcaaaaaaagacaatccaattgaattagtcttcaattcgatatcaaataactcaaatgtttttcctgaggggaaaaaacagaaatgttatatatgcacacacaattaagttgacaaaaatacaatacagtgtccctttgtgttttttaatattttgatacttcgtgtaaattatataagacgagaaagtaagtgagagttagagataaaactatatggtgtcacacatacgatgtctaaaattttgtgtttaaataacatagattatcaaatgaatattctgaccgacttcatgaccgacaaagcagcttaagaaattgattttgtgggtaaacttagtatcttagatgcaccggtgtaaagactcatccctcaaacagaggttgtctatgattcgaaccttaaactatagaaatataataaataatttaaactattttcattccttcaatttaatctcaaaattataattctctttcctatttttaaaagaaattgaggaattggcagggataatttgtgtaggggccggggttcgacccccgaattccccacttctccacacataatgtgtgtgaatctagccactaggctacttgactaaaaaaaataaaattgagaaactggcttaatagactaattatagtttaaagacaacttattatacttttataatttatgtgatcaaataagagagcgtgatagtttaaaaacttattatacttttatatctgatcaaataggagaatgtgatagtttaaaaactaaattgatcgtttatgtcttttaaaatgaaaaaaagagggtgattggatgttccaggccttaaatgtaaagatagtgccacttgtaagaattttctacttggtaccccgggtcctgctattcttaatttctacccacaaatccaataaattgacaaaaataatatttttgttattttgttcaaattatttggaataaaatagaatgaaataaaaaaatatccaaaattttcaccttttaaaatttcagaacataattgtgttatgaatatttcatttaaaaaaaaatgaacaaatttatttacaatctttcacattttcctaaagaaaaaaattagcttcatgttttcagctaaatctggagttatattttgttccggtctttatatatgtttgttcgttggttttcatttctaaacaatcgcaccaaataacactcatttttttacacttgaatgagatgataaaagatctttttagttcaactagaggatactcgattaacaaaaaaaaaaaaacctctgctaattttattttttatgagccaacctctactaaattatcttctataaatttaagcaaaagcaaacctaaagggaaaacatgtaatgttcattgctcatcacatcaccccttcacattccagcctgttcaatatagttttattttcaacatttgttgaaaggccaaatggaacaaggcacccaaacttaaccaaagtttgtcgttttttttttgtagtgactgaattcaaactcgaaccttgcatatattatgcattgtccttaccaactaaactaagctcacggagacgtttgccatatcttttaacaacggagttgaattttggaaatagaaacagatgaaattaaagtggtcaattacaagagtgtcccagtatactagctagctatagctttatacttgtggtgaccaattacagtacactataacaattactatagttataaaacaaaaagaaaatgatgatgagatgcttgtaaattaaatgactctatcacgtactctgttacttgtacagctacgtacatacaaagttacattaagcaataacaaagatagagatgtttggtaaggagagtgtggactagacatatgcatatgacccatttttagcagaatgtttgctggatttgttgagcaagttcttcagcactcagttggcattcaattccaatctatataaatcaattaatacaccatagtattaattagaaaccactcttatataatatattagtggacctaaattgaacacataagtagcatataacatatacatatatgatatacccaatcataggcttgctttcatgagataataacaaatactataaataatatatacgtctttttcatcaaatgaggacaaatgtctgaatgaagtcacgatgcatgttacatgtaccttggcacaccagagaggtgcagtgaaatatatacagccactacttttaaagtacatcaaaccatttactttttgacatatataattaatcacagtaaaaaactgcactaggtattactagcataaagaaaaatcattgttactatacttgattttattgtgatggaatatttttgttcctattgaagagtaaaatgaaaggaaaagactacacatgcataataatattccaagaataaacgtaccttgatagtgaaggagttcaacatggtatcatcagaagtactattaatgttaacatggagaatttcaagtgcaagatcttcaagtgcagatataatcttcaaaggttgtcctggaattctttgagaaacagttttcaaaagaacatgaggacctgaaaacttgacctccacgtcagcaataggagactttgaattagcaacaagttcattgatgttatcattgactgaggaagtagaggaactagtaggtgatggatcaagaggtgaaagtgcaatgtagctttgttgcattcgtggtttgtaagggctagttggttgtggagttcttggactaattggcaagtttagtcttggacttagaggtggttttcttggacttagtggtgaaggtcttggacttggaactaatcttggacttagtacttcactgtatacttttctttgtttcttggcttcaagggcttggagtagttgttgcaactctgtgatgtaatcaactacacctccaattattgatgcttgatctccctagttaaattagttgcattagattgagtgcataagggaaatggatttgctgcaatcaaataatgactacttatctaattttaattagtgagttataatactttttatttatttgacaatttaaccatcttcatcacataactacaagattcctatgtagaaaatccgggtctatgcacaaaaagtaatcaaatttataagtaaaaaaagcaaaatattgatagatcagctttttaagtcacaatagaattgttatttttttcctgtttttttaaaaagagccgcgtaaatgcagaccccactgcaacaaattataatgcacgctccacatcttagataaaccataagtttgcactccatgtgagtgtagtagaggtcacttgtctaggttatggaccttcgtaatcacttattgaccccatttaagtaagtaatagagttgttaatttaagtacaatggaaacatggtgcatgcatgaattcattttctaatttaaaagggtaatcttagaaagaaaaaaaaaattgattttaacatgtttcattaattttttaagtccaaatgctatattattattaaaagtatatttttatttgaaacatattgagttttaaccttaaatctattgttcaacttaattttacatgaatatatatcttcgatctataattattatatatttaaaatcaatttttgtaaccatagaaacaaatatacacttacccttttgacataaaagcaaggcataagtgaccttaaaacagacaaatgctcattcatttgctttcttctgtttcgctccacagtaatatgagaaaccctttgttgtccatcaacactgttaatctgttcctcaagcaaagttggtgtcagcttctgtctcttccttttgggttcagtttcaagttcagtttcagaatcttgcagcgaagaggttgatttttgagacaccaatctcgatgtcgaagtgacctcattctcttttggagtagcagcttcagcttggttgataagaggaaaatcagtaaaatcttctagactctccaaaatggcgaagagatcatcgctgttaccgaattctgttctgtcttcaaatatatcatataagctttcatccattggaaaagattgagaaatggaaaaagtgtggagacaaaaatggtgtaaatataggagaggtgtttttctaaaccgttagatgacaggaaaggaatctctggagaagcagcagatcagagacagaatgcagaaatattgcagagagagtgagagagaagatagagatagaagataaaatggggaaagagaagggttttagaagttttttatatagtgatagtagtgctaaaggagtaatgtttatggagtagtaataatatatgtagctgcatatatacttaatttagggtagttagttattttgtctctttattattacaagtactgcaagtggaggttatataaataaaagggtaatatactactatgcatgtccaatgagagttaaatatgctgtttgtaattaggcactgagggaagaaaaaactgagcatccatccacattgaaattgtcattcataaataccactgttcttcatcattaatatgtcattgaaatgtttggtttttttatttctagtgggggtgtgaacggtaaaatatttaaacttgatttgatgtacctcggatacttgtagtctagcactgaaatacaaaagcatttagtagataatagtactaagatcacctcaaaacagtgttgatccttagagagtctttaagttcaataaatgtagctttgttagagaagattgaggcgacagcaccatgcaaaatgattgtttgttgaagcaactcctccataaaaaactgtaaaaagtaaacatttgtatttaatatctcttttttgtgtataaaagtaaaaacagtatccttcaaaaaaagagtaaaaactaaaggtaatttaaaattacatttaatcaacattttaagttaaacaaaaagtatttgtcataaatagttaaacatatagcattattagacgatgtttacacaaaaatataagtattcaaatcatgtattggcgattagactgaaaaagagttatctgcatatcagcttcgtcacaattagttggcgttggaataagttgatggtgtgaatcgactgacatctgaattgattgacggttgaacgagactaccaagtctatataggttaaaaagaatgttataacccttattgaaaatatttgcatattagctgcattacaatcatctaactttgaaatcatttgatgcataattgaaaccagttgttgatggttgaacgtgactatcaagtctaaatggactttgatgctattagtaggtcttatagggttgtgattaagtttaataagaacccaagaggtaatataatcagtttcctacatatgtgacatgataaaagaagtgttaaagagagaaaaaaaaatatatataaaatttactgcaaagtcgctttgaatgacaaataagtggtcaaattaacattaatcgttttctttaaaataggattgtgaagaacacggttagaagacaaccaagcagttagtcgtacaagtacaactctgccctcaactcaaaagtatggacaagatattagctaactaagtccagaatgcgcacgaagacgtattcccataataatatggttatgcatgatatagttggttgatatggaagtaaataacttagcatacatggaagtttcatgttgtaactcatgctacagggtagttacctacattagtggtgtttgccatgcattcttagcggtgaaggtctttacatatctttttttcgtttttctctaatgctttcttttattttccatgcattcttagatagtaattcaaccttgaacactaaaaccaacgtctctaggaacttgcaactgagatacatagtctctttcatagtgtagttgatcccttattcgaaaaggggatcatagtctaaagtgcaagttagtctgcatatcatattatgaattgagctaacgaagaatcaagtaacaaacgactaatcaactgatcacatgagtagtcgagtaagcatcaaattttgcattaagacaacatgcttatagccaattctgaatttttttttttttttgaataagcaaattttattagctaggataagccaattctgattaatagtatcagttatgggtatatttgaagaaaacaataagtatattcaataatttggtaatagatatatattagagacaaatcttttctcaaaagagaataaatttagggacatatacagttaataattaataaatactttaatttagcatattgcttttgtctatttttataatcacttcttgtgcaaatgcgaaaaagtgcttataaaaagggacatagcgtgtaggtatttgttttgattaattgaacaactgtgttgtttctgttgatcatagtatgattgtgtaattaattactacaccctccgatcattattataagcaaaaatcaacattttagatacatttattaaatgatgtatgtaatatttattataaaccacatacatcatttaatgaatgaatataaaatgttgatttttgattataatagtgaccggatggtgtatatatttgctgcttaatgcctaggttcaaattatatatttatattatatttcaccctggcccaattatatgcatatatttaataatagaaagacatgtggttgtccccgtaagctttgctcagttggtatagacaaatgcattttatatgcaggggccggggttcgaaccccgaacacctcacttttccatatttaaaatgtgtgagctccagccactaggctacctgaaaaagaaaaaaaaaaagacatgtagttaagaagaatgaagcctgtatgtataaaggagcagtgatggtatggaaacaatttaaaaagaagccttggtacctaggtcactttttattaatttatggagggggaaataaaacggaacaaatgcattcataaatgtggttgtgaatgtgaagtgggaacaccgttattgctacaagaccaaaaatggagaatgttctgcatgaaaaatcttactatacatttacccagcctgtgacggcactggtataaatattcgactatgtcctttgcatatgtttgccgtgagacctagacttacctttgaagaattgcaagtaatttatacaacatcaatgaaaattaatcccatatagttcataaacatttaagatactttgtttacatagtaattttttactctaattacaaattgaatcctttttttaaggattacaaatttaatcttgtgtttagtttttattgggtgttgcataaactacactcttttttaaaagactatgcaaaaaattgatatttgtacaaccaatcgaagaaatctctctcatactatcaccatgttactccaccccccatttttggccgagagaagaggaaagatgaaggttgtcacaaaataatcgtataaatgtcattactaaaaaaatgactccatctgtttcaaaatatatgtcgcaattttacaatgtgcactattcatatagcttactttaaccatattttttaactaatatataaatacaaatgttagcatataagatgtttgatttgtctcgatgaatattttcaaaatatcaattttctataatttttattatatataattaattataaaaattatcaaagttttgtattggcatgtgtgcactggttgactgcgacatgtattttggaacgaatggtgtatgttcgtttattggtttttgtgtgatttctaagaaaagcctttaaaataatacaatcatttttctttttttgggtcttgctaacaaacatctcatagatattagttaagatatccacaaataataattttgtcttgaaaatataagtaaatacttttaatcaagatacacaaaaaatttctttttaaaaacttactacttattttgattgattagtcaatgcctctcggacattgtccttctttttcagacattaaaattcacacttcacacccttttttcctttagcctaaaccaccaaaattatcaccgttcctttgtgctgcactctcaagctagtatgtaaaaatgtaaatttaaattagtctcaaacgccgtaaaacataacgtttgtgactaatcacaatgttacttgatgatgtgttcaaagtgaattattaaaagtcttcatcactgattaatctttaagatcacaaaaatttcacaattaaagactccttaaaattgtaaaatgttaatcaaattagtcctataaatatttgtgcttatgcatgtcataaaaaatgctagcaaaatagttaaacgttcaactaagtttgatgtgtacctatggacagatatttcatacggctttgtgtagctacaactacaccgattttattttattttacatatgaaagatatctataagaataagatgttaaagttggtggttcattttgcctcaattggtgattgttagagttacaaacaaacctgaactaataaaactaataaaattgttatattcagttaaatagtatatctctacctaaaattattattttagccaccaaaaactaatagactaaaatgaaagtccccacctcaatagttaggaagcagatttcaatagtttttttttttttttgagcaaaagatttcaatagttaaatccctaattttgtttaaaattcctcattttcttccaattctccccgcggatttggatcctcactagagttagttataaaagcaatagctgatgtcactcaaaagtatatgcagcagttgtatacaagagtaaagtagattttactatataagcctgtcttttttcaagagtatatatatatatatatatcactgtctttatgatagattatttgcaaggagtgagatgataaactagttgaaatacaaaaatggagaaataggaataacattgaagcaagggaggaggaccttcgtggaagacgaggggagagtgtgtgggagagagggaagaataagaggaataataaaacttttaaagaaaatagagattctagtatagtataagatggatgaaaaataacataagcactaagttgagtaaaaactttaaagttaagagttttttttgttttccgtaatctcaatgactaattcaaacggtcttatagaggggaatagatcgtctcctctaaaaatatttgttattttcaccgatgtcaaatctaaatcattaaacattttctctctcatgattttaacatttaacttcttaaataaatttatttttcaatgggtaggatttccctagaccctccagtcacatagaggatctagtccctcttatagagttatgatctaatttggtgactagaactttcaatgttttcaataggtcaaatgcatctaaaagtcctttaagttttttatttcttccaaagtggtcctttaagtttcaaaggtcccaaataagtccttttagtttttgaattgtttcaaacaagtcttattgtagatagcatagttggtaattgtttccttgaactcatctttggtaccaaatctggctcctaacactcacttaaaattagtcatctttttaggcatggcaaatggtggataatgctctttgttgttatcatgtaaatcatcatcatcatccttgaaaatgacttgtttgaaacgattcaaaaactaaaaggacttgtttgggacttttgaaacttaaaacgactttgagaaaaacgaaaaacttaaaggacctttagatgcatttgacattttcaataataacaataataaattgatatttttctcttcttacttatttctatttgtatgtgtgcttaaaccaattatttctgtggttgtgaccatacaagaatcgctctcttttttaaaaagaaattggagtcctcttataaaaaaaaaaaaaaaattgaagaattagaaaatatttttaatagtggttgtactaacgacctatagggacgtgttagtgactgatactttgttttggagttccaatgagaagcttataggcaatgatataaactcaaaaatcaaacatgacgctatcacttaaatacattaataatttaacaaaatgaaactgatatcttagagtctaaagtgtaatgttgatgtgtcggatatcatacacgtctttaattccagtgtcggtgctacatagcttatgaatgatttttctttaaattgttaattcagcctccctttggaaaaatgaaatatatagtgaactatggatgttattagttataaactgcatcatgcagccatggaatgggaagggtgttctctatgtcggggagatgtttggtgcatttatgaaggtatttggttttttatcgcatcttcttgtaaaaaatatccgttagttagttagttagttctgaagagaagaaattaaagacatggaaagacatgatcaaatgttttgagatgaattttatgagactggtatttatttattctgccactggtagttatcagcacagatttggtactttattttcagctggctggatgtgatattgtgatgattgatgtcccacaaaaattatgagtatattttcaaattttgatgagtttaaagatgaatcgatacaggggggatttgtaatgtagtgatcctctgatgttttgcatagcatgaaatatacattattcaactggttttatatatgcacacacaaaaagctacggttgcaatttctttaaaatataccgtcttgtctttttgttgagtaaatgtaatttgtacgtcttcgccatattgacatgttttactgagtaatagaccgtccattatttcatcaaaagatagagaacagagcaaatttacagtgtaggtacatatatacaagaaaaggaatacaaccacgttgcaagtaccaattatatccaagcaagatatccatgtaatgtactgattagaaaccacgttgtgaacagaggttggggagcatctattctgtatatttttacatcacgatcagaaatatgagaggaccagcaaaacgagtctgccttagagtttatagtgatatatttggtctaacaataacaagtttgtttgtgttcctgtatcatttctgagtaagagtttcacattggatacaaaagtggatgttgagcattttaacttatgtgttaggttttggataaagttgttgtgttcaactcacttgtgtgattactcttgatccaatgtgaatgattctcacactcccccccctcgtgacgcaaatgattaattgaaatctaattcaaattctaatatggtgtaatgcttaaacgagttggcagcataacatcccttagattttacatttatttgatgaactgcttaataaataaaaaaaattaaaaaggagcaactttgattggttgaattgtgtttcgtgactgatcacttcgagaagcttttcctcgagatatatagcagtgctggaaaaggggggccaaattgtagcctatgcgaaacaaatttaagtccccactcttaatttgggtgttgtagtgctcaactttcaaaaggagttttctatatttttctcaatttgtacatttgtgatttaggtgtaactacaacaaacttatattcggtggcatttttctcacttgcgactgtatttttctctaattcatggctaccatttaccatctcaaacttaaggatcgtgtttttaatttgacgggagacaacagccttgtaatgttgttccatcttgacgatggcgtgaccgatttaaaagtataatatagtgaaggaataataaattttgaaatgcataatacacatgcacacacaaaagatctttgaaattataagatatattcaaaattaatagatatccaaaatcataagaaattttaatgatataagaaaggcaagtatcttgaagtttgtcagagaatgacgagactaacatgatctttaaatagaacagaaataaaatatgaaacaacaaaaatgcagacatgtgaggatgcaatcgcaaccaagaaatcatttgtagtggtcgagagtatttgtttttttttttaggaaaaataaaaatatattaaaaagaaagaaatgcaaagaatgggggacattagacctgacctaagaaatcgtttgtaatggccgagagtgtgaaaacaaaatcgcatgcaattattagatatttctaagcgaaatcacaatgaagaatcataatttgaaattctagttaaagattaagattcttatatagcctagaaacttatatatagttgtttaaggttcaatatattgaatgaaaaaaataaacattgagattgaaaaatataacagtatactactgccactgcaatattaattgaactcaatgtcataggagcagggtcgagtttaactaattattttattaagaaatatgagcattacttaaaaagaagaataatatgtgaccgtgggagtatttgattggcttatttgagttatctttaggtgcatccaatgtattttaggaaaatgtcacaaacaaataaataaatgatgaaggtgtacaacacaggaaaatgttagcatatggaagtgatgaggaatggtagtgagacaaatatctgcaacttgtgtcgttccttacagagctttcaatgtgcagacacggcatctccgtgtctacgatgatcactctctctcttctttgaggggtcactagttgcagaatgactctgctaccacccattcacaaatatgcaggagttattgctacccttcttctgcatgggtgtgcgtttcattaaaattcatatatacaccctcactttacaacttcttcaatttttctcatttatgtttcttcgaatacgtccattttttccctaccatacataaattttcacatttaccaccctcaacaaccaaccaaccctcactgtctctaaatttcacatgatgccaaaacaaacaactctgaatttaattactatattaggcccaaaatgtttcgtgctgtcactgtttttagtttaatatttggtagtatatattgaatagtgtgatgagtttaacagcacattcatcttattgtaggacatgctatttaaaaacttcggcgggttcttaggttgtttcaaatcggctactttttaaacttttttcgtatattctcataacatgcatatgaaatcaagtggtgtggacaattcatatatatttttatctgcctttaattgttttgtaatactacatttattattccattcatctcatattatgtgtgttagaataacaaccatccgattcaaaagagtaaagaaacaatcaacagaaacaatgtatagacaacgttaatgaagttcaaccaattgtgtatacatctccaaatgaagagcggttgcagatcatttatattattcagctcagtttggtaaaaatagcggatgactaataagctagctgatagcttatggtttatagctgatggcggatagctgataagctacttgaagtgtttgataaaattagtggttcaattagctgatagatgtaaaattacataaaaggacatttttaattcataataaagtttatatcaattaatatttaaagtatttaaaaattaaaaattattaatttaatattattattaaattaatttttaattcctaaatgttaatttatatttattttcatttgcctaaaaaaattagatataaagtgttaaaaaaattaaacgtaacaataaatatagtttggagaaaatttaaacgtaacgttctcatttttttttttttggagaaaattattgtcattgttcttattctctacaattctgatatatcatacaaaaataacgtgtcattttgcaaaaaaaaaaatgtgacattaaatattgaaatagtcccaaaaaaaaacgtaacaattgtaacgaaaaaaaacttaaacgtaacggtaaaaaaaaaatctttttttattgagaaaaaaaaggacctttcattcataaaaaaaaaatagcattcatatttaaaacatatgtattttaatttataatataataaatgattaagggtaaaaaaaatggaatttagttagaataataagggtaaaactggaattaaaagtgagaagctataagctcaaacgctacttggaatagcttctgaaaaatagcttataagctcgtgaaataagctataagctcatggtgaaaaagtgttaccaaatagaactttttttgtcaaacgagtttataagctataagctcttttttgggtgttaccaaacagacctttagtgaacagattatggtttatatttacttataaggaaacaccggtaagtgtcttacggacatatgttaaggtacccaaaataaaaattaaggtacccaaaattgtttcaataaataattattctttgaggaaaccttaacttgtaccattataatacatgttaatctgacctttatataacttcctttcttagtatccttaaccgataccccgaagacacctgttagcatttcccatatttaaatactaaagctcatattacaacataactcataaatagtttaaacatcaaattattgatcaaatggatcatagagatggtaaaatataacttcgtttttaccacttcaagtgtgacgagtgatgtaatgctctcacaaacatcatcaaaatgattgaggtctttcttaaaaaaaatgattgaggtctgtaaccaacatcccatcatttaatattgtcatatcatttttgtatatttaattattttataatgaatttaaattttgaattaattatgtccacatgaaagaattttgtgaagcattttgtcaaagtttttttttaaagaatcaaagttattattaggtaatttcaaataccacgtaaaaacaaagaattcaaaattctttcattactcaatacaatgttaatttcaaattgatccttattattttaaaattttcatgtttgtcactataaactttcagaaactgcaaattggtcgctataattttccaaatttcataaattattctctaaatttttaaattggcctttttcaagttttgaaattttacaaaaataattcaacatagttaagaatgaaggatttttttttactctatacaaacaacaacaaaagagaaatagagggaattgaatgaagcattcaaattgcctagaattctaaagttctaattatcccatccaggcacaatcttatggcctttgctttaggttttctaacttttatttatttaagttcatgatccaaaataaaataaaatcatccaaagttgaagttgtgacaattggagttaaaatgatgcatccaaacactatgctataatttactttcaaccaatacatatattgggacaatatcacttctatgcttcaatactagcccatttaattcgctaattttttatcctatatcccttttttttttatttagttgacatagactcaagtaatttcctaaaattaagatggtgtgtcaagaatgatcgggatagctcagctggtacagtagaggattgaaaatcctcgtgtcaccagttcaaatctgattcccggcgtaaagacctcctcctagaagctcaaaaacaacaaaggggtataattactagaagtaaacctaagagactccaaatgaatatggaagaaaaaaattgctactaatggaatttaatcattgaaaaaatctttttttttaaaccttcctcttagatttgcatcactagcaccaatcaagttgaactaaaggggagagtacaggaaaagtatagcctcgtgtcatacaaacaatatcaaaaaaacatatgtataagcatgaatgggcaggccaattattttacattcaattcactttaacctaaatcaggtcattaaaactcaaatacactaaatcacatatgcattagattgcataagaactatatatgattgactgtaggagaaagatagcttgtaaatcaagttttagggtattagtaagctcctttagagattatgcacaaagtcagggtcaggctcctatgctaattacatgatgtatcaggtagatacttttggtaagccacattggcataattcatgatacatatattttgtttcatgaatcattccatggttagagatgtttgataggcttacgcggatctagataagctacactgagcatctttgtattttctacttaaattcaagcatataactgtctcgatcatttatggacctgtcacacaacataaatgggaatgtgggacaaaatttaaaaacaaaatgttactacaatataaaattaaaatgaaaatgaaattaataagatgggtcctagctccttaacaaaacttcgttcattttccaatctgaaaacacatttattagcaaccacgaaatgtatgagcaaaacattactgctttttcacctaataaataataaaatctcccttcttttctctttctttctcacaccccccttttgtatgttcttactctggtgagggtttcttggtaattgtgtggcattcacaacgggatggatgttggaggtaaatgtgagtcccacatgtttgattctgtgcttgatttctatgccccattctagatgtcatggccccattttgttgccttttgacctttgtggcctaaatacggtgcaaacctcatttccatggatattaacttcgctgcatgtgtttgtcagaaaatgttaacgtaatttagaaaccttttcatgagagtgagagacatgcaatatgatcaatgtatgcaaaattgcactacttagctcccattatttagttagcactttcgattctcgagttaatttcatcactcctaaataagtagaattatcaacaaaaagttatacttattttgcatagagtgattgattttgctattgaaaacgtttaggggcacacaacttattatctgcttgcattccattcatgtgtactccaattttcatatataggtacaacaaaaattacttacaaaattgagctaggtggatctagatcgaagcagtgggtgtggtagcactacgacgatcaagttagtttaatattcaatgagtgatgtttttgtttagagtgattgtgtacttttctcgtatgcaagtgtctttatataggatgagcttcggaaattcgtggtaaaatttgttgagtcggttaagtgaaatacaatgtgatctccaaatcatcgtgtgatcttaattaatcatgtggtgatgattgaatcatgatttactatgaagtgtcgttaatgcggttctttaattaatatgaaatttctaattttagcgtcttggattgaaattagaggtttcatgtttttctttctctaattttttacctaaatcaatttttatcctaggattgggtttctaaatttcttcaaaaagtttatgagctcatagttaggtttaagaacaatttatttctataagttgcataaaattagagacagtactgacactatcaattagtatagcagattgtacaatctcacatatgcatgaataagaattaatagaggattatctttggttctcacttctccttactcccttaaaaaagaaggaccttagtccttgctgaaagatattgtacacaagacaaaaaattataatcattactagtatttttctagaagcagcaagattaagctgttgtacattatggctgaaccatcggtggcagttagaaaatatgcagtcagaactcagaagaattcacagtaaaaaccagagaaaattatatggatcagtttcttgtttttatcttgccaatgaaattctgaaaatctttcgtcagtttcgttcttcttgtagaaaaagatgcctgccattttgacatgccgccataccaataaatagatgagtttttcaaaattgtcttgcaaaagtttaaacaaatgttgatgaatgttctaaaggatttttaagagtttaaaatagtaagattttatgaatatatatatatatatatatatatatatatatatatatatatatatatattggaaaatgttaacttgtccctcaaggcacaagttttcttttttgtctagtagctacagctcacataatttaattgtggagaatgtggggtgttcgggattcaaacaacggcccctacatataatatgtaatatccctactaattggctatattggaaaatgttaacttatgccctcaaggcacaagttaagaaaccaaagataaaaacattttgttggaaattgtgcatttaatattttagaaatttgaaatcttatcttttcaggacataatttatgatttaattctatttttagatttttaacttgtgcccttacggcacaaattaacactacccatatatatttaatgtcttgaaaattaaaatgtttacgtaaatgtattcaaataactttttttatttgaaatctttaaagggtgtcaagtgatcattttcctattttttttatgaggtataaatatttaaaaacataataattgattaaaatatggatcaacctaatactattttaattaaaaataaaatagatataattagatacaaaagtataacacaatattttattttggattgtattctacaactacaatacttttgttccttttgatttgtttcattatagttttcttgaagtttatttttccataatgttttaatagaataatatttttatttttttcctttaaaaaaaaaatagaataatattttttcctcatttacattatgaaatgtattaattgttttttaattaatggtgtatgatagatatcattcaattttgaattacaaatcacagatactaaatcactaaacaacacctttaaaaaactcactaaacaacatacctaaattcattaaactatagaacattgcctaattcataaaactatatcactaatcatcatcctcatttagaacagatgaccaccgtggagcaatacgcctcgcgatcaccttgatttccctatcctcctcatgcgcttctaatagtggcatatgatgtacagagacaccacaatcgtaagcaagatcaataacccaaggatcactgaaattaccacagatatagtgtaacaccccgtttttcactaggattatttatttatttatttattatatgtgtttaattgtttgtttttgtgtttgatttgggattagtggatttttagacgagaagggtattttagtcatttttaaactaagggcatttggtcatttaatgagtgagggtattttggtaatctttgaattggaggatatttagtattttagtgtgatgaattattttagtagggttagttgtaacttgggaaaccccgacagggaaaaacaaccgagaaatcatgagtaataatatctctcaaagtttaaaccttctatattttttaatagtaaaatatttgaatcaattatcattaattattacctctataattaaaggcaacatattcataatacaagacatttccatcaagaataatgtttgacctataggcttccaagtcgtcgcactaagatctggttttgatgctttgtattcttaccagtgtgatattttttttataaaggcatcttatatgtttccctgtaccaattctataaataattcaaaataagcggcattgtacattagactttatctttacatatgatattactatgtaccgaaattgaacaataatggtcaagaaaaggtcaccaacacaaagtaacattataactcaaggacgaaactaccaaggtcatccatctgatttctaaattaaatttggaaacatttgcagattttcaccttttactttacataaaatcaacctagacgtaatttaaaaggccatgaaaaccattttcaacgacatttttcatgcaatcttacataagaagtgtaatgtctctaaaaggatggttggaattgaatgtatacaatatttagacacattattactatggtaaggaagagacaaatgtatttgagttgaaattttgaatgattttttcacatacagagagagagatttgttatagtgttaaaaatgaataaaattctacaatacttttttaaatataaagacaagtaataaacaattttaatttgtagatgttaatgaatctttaatttctctaatatataatagtagtgtttataatctcaagtatttttctcaaaaataatgacgttattattttatcacttacacattgctaaaattttgtataaatatttattatatataatctcgcccccacaagtcaaaattttggatatgtcattttatatatatatatatatatatatatatatatatatatatatatgtatatatatatatatatatatatatgtgtgtgtgtgtgtgtgtttgtgttaaatcttataatagaagtatgcgtgcaagtagacgtgcgtgtacgacttataaaaaaataaggtagaaagttcatactttgcaaagggtaaacaaaatctcaggacatcctaaattcaataatgtagcaagcaagatggatccataataaccaccaacaaaaattaagatgtgttaaatattttatatgagtcattatagttttattgaatttcataattatgacattagttttattgaatttcacaaaataaccaataatattggtgtaacaactatctccaataactcgagtcatgacaaaaataatttgaacacattaacacaacaacatttagtaagaacacacaactcctatgtattctttttcttattttcacacaactccgatactcaaaatattagtaacaaggtccatgacaacaaattgattatggttggttcaatatattaaagaatattgaagacaaatctatgtctagacattcatgtttttgtatgagatacagatatttaaaaacatagaattgattaaaatatgggtcaacctgattctattttttaaaataaataaaatagatactattagatacaaatgtataacattacattttattttggattgtattctagaaataaaattattttgttaatagaataatattttttctcgtttacattataaaatgtataataattgtttttttaataaatagtgtatgatacgatatcattcaatttacaattttccacaattattcattgtaaaattaataaagcgtgattgaaatattatataatcatttaaaatattaacctaacccaaaatactggtgaagtttaacctgggaatgaaaacttggttcccaccatgggaaagtttcaattcccaggacaggtggcagttgacaacctgctatggagagagagaaaaaaaatctgaaaatagatttctaatgttttttgtttcttcccgtgcaccccccatttacttcagtattgtctcatgactctcatctcatttctttctttccagaactgatttcttttcaacttacccagaaaaaatataccaacaagcatcttcttcaacatctcatcttcttcaaactcaacatcttgtttcacatttttcacctaaaatccacatgtttttttttactgaattttagagttgtatctaagtgtgctacagatctacatattttaccttttctgaaagaacaatccaccgataatgggttttcttattccaaattagacctataaactgcagatctgaaataaaaactcttaatttgatcgatgtccatgaatttcattgcaagctgatagtttcacatatctattctcaatgaaattcgggtttagttgtgctaacaatcaatagaagattataacaaatttatatctatcatttttcaattattttagaataatggacgataaaaaaaattgaaaatgatgggcacattcggctacaatgtaggtcatgaacgttgcaatgcttacggcaaccgctatccatgaatgttgctcaaattttatgttatatatttaaatacgtacataatttcaaaaaaaaaaaatactaattgctttaatattgtgtatattatttaatataaacaatgtaatttaggccacccataatgaatgtaaaaaaaaaaaattaaagaaaaaaattattttatgtcacatacaatagtacacatgatttaattaatttactgccacacgttattgatatttttaatcaaattttgaaaatttattacatccttctctaattcaatttaatatgacagcattctatgagatcaatttagttcgaatttttttattgaaatcaataagcccaaaccaaactgataaggcacatgaattcatacaaaaaataaattaaaacaaacaaatgctaaattattatttaattaattggtgggataggaatttttgttacacaatgtccaacaagttgcaacaattaccacttcttcaatctcagccattcaattaaaatactattaaatctatggttgtaaaggacactttcccatcatggaaaaaagaatcatttcccatactaaacgttacccaaaatactcccctctaaaattcttaaaaaacccacatttatttaaataacaaacacgagatttctctagtcaccttagatacattctcgtttacgtttcctctcacctctttcctaacaacaacatgaaataattttagtcaccacttttgaaatccaccgtaaactttcgacgatcttctctttcataatccacgataacatattccaaatcaagattcaataggccaatcattctttccttttccattaaatgcggtactttgactgtaacttattttaatttgttcaacccttttctatatttgaagttgttttgaacttgtatgcataaatgtttatgttaattgttctttatgataatgtgttcacattttcatttatttttaaattggttgtttttatgcatataacgtgtttgtagaaatgcaagcttgttttttaccatatgaattacaagttttaagtcttgtatgtgagcaaattatagaatgttatcactgtattttgtgttcaatgttatacggatgcatacaacgtgtttgtagaaatgcaatcttgatttttaacgtacgaattataagttttatgtcatatatgtgagcagaaaatcactatattttgtgtccaaagttggctaaagaaaacctgtcattggggggtgttcgtaggtgggcttgggaaacccaaaaccaaatcaaatagggtacttcgatttgggtgaggtaaaataaccacttgtcatactattgggtgggtttgggcaatcccactaatttttgggttgggttggattgggtaatgggttatccaagttatttttctatttttttaatattaaatgattaaatgacatgtcctcataattttgttttaaaatagtattctactttttaattttcttaaaaagaatgtttaacttattttactataattttatgcatcatagaatatcaaataataaactccatcataaaatacttgcaacaaactaaagttgcatgacataaaattgcaatagtattaaaataaacaaaaagtgtaacatattaatttgtaactctaatatgttttgattttcaatatatagggtacaatgtgtatgtttgaaaatataaatttcttctaccctatgaaaataaatttcttttacaatcactaaacaacatacatgagtcactaaacaaactaaagttgtaaagtgtgtcatctctttataaaacttgtgttgcacctctttataaaacttgtaaagtgtgtctcagtgataactatcaagggctctttgcttcaatgtttagtaaacaaaaaaaaaaaaaaacataacattacataaatcttaaaactagatcactgatcatcatcctcataaagaacatagtcttaaaacttgatcactaatcatcatcctcacaaataataaatcactaaacattagttatgttgtttagtgatttaataaaaattatttgaacttttcacacacattaaaaattatttaatcaatatatatgtatatcaaaatagttttattctattattaattatttaaaaaatatctgttatttaaaatatctgttatttaaaataggttaattatattttggatttctaaaatatctgttattttttaacaaatataaaatattaaaactataataaatttacaatggacaaagtaataatcatataactaatagaatagttatccaatatgcaaacattaatagatcaactacttagaaatttgaatatgtttgacaaattccatttttgagtttacaacgtatgtcttatggcagctgaaactataagacataaaatcagtggttgaattaacttataaatatgaaatgacataaaatgatatatttaatatatattaaatttatttcaataaatgttacagggataaaattgagataaataatgataagttaaaagttttaagatacgagatatttgaattagcttatcaaagatgatataagcaagtaaataagcttactccttaatgctattttgacataagcttaagtaagtcaccaacataatgaacaaaggggggtagcagacagttgaaccccaattcaaagttcaatctgtctagagatcaatcttttaaataaatctcagttactaagagcggataagtctacataattactcgggagagtacctttactttaaaaataaaataaaaattgaagtcagtcatgatgcttcttctacaacgcaagcagaaggattctattagtttttttttaatgcagattatttgcagtgcatagaaactttttaaaggatttcaattgtcgatagttgttataaaaaaacaaacaacacaagatagaaaccaaatttttgttgattttttttttttggatgtgtatattttttttcccctcaaaacagtaatatgtctatttaatccctcaaaaaaaaagtaatatgtctatttaaaaaggtatgttcgatataagaacatcaagtggctgtagtttagtggtaagaattccacgttgtggccgtggagacctgggctcgaatcccagcagccacactttttaaaaatcaaaacaatttttttatctttttatatttttggtttagtaaatgtgttttattcatccattaaaaaaatacccatcatgatcatggttttggtgtttctatatagaagaaaacatacccaaaaaagtgcaaaagcaaatatgagttgccattgaaaaatattattggttaaatattaagtaagaacagaaagaaaatctcatgttagtatattattgtagattctcctaaacatacgggtacaccttcaattaacatctcaacttaggtggcttatgaaaacttgcattgccattataaaaggaattccacaaagctaattcattttcaccaccccgaacatctttctcctacacaagtcttgttattatttggattaattagttaatttctctctcctttctttctctctaaaaacttgaaaaatcaagagagaaagagaaggagagagagaaataaaacaacaagaagaagaagaaagaaaatattaagagaaacatatatggctgtttcatgtgcttcattcagggtggttgccttccttggcctcatttatgctacacttatttctgtggcttgttcacaatccattgcacctgcccctgctcctacaagcgatggtaaatattcttaattttctctcatttaatttttagataccattgttgatgtttgatcaatttttatttgattagttaatatattcatataacaaatatttttctaatgattacaaaacaaatgtgaaaatcgtttggaagaacttgagttttttttttttttgttacagaagaacatgactttgatggaacaatctttaaccaaattttacttacctttgtcttaattatggattgccaagtccccttccccaaaactaaagggttgtggccaaaaaattcatcatatttaattttcaattttttatttttccatgctatattctttatgagcattattgaaaggagagtatgtagtgagtattgctaatgaattgttgttgtttataatatgcaggcaccaaaattgaccaagcgattgcatgtgttttaatgcttgtggctttggtgttgacctatatcattcattaatttaaccaccagagagagactccttattcagctctaaattcatgaagggttacagagcctaattttaaaggcaaagatagttattcattcatgtcataacagagaggaggatgagattttaattggagaaatgagttgttgtaattctcctatgctccaatgagaatttcattttaatttattggttgatctatagattattgtgttctggttttcaaataaaactcctgcggtttctagaccaaaaaaaaataaaaaaacatgttaaaagacttattttttgctgtcgagtagctattaagatttaccaaatattggaatataatttcttggatttaatttgttgtataggtaaaaataatatgtattcaattccaatcaaattacattatgatgttattttattacattagtttgaaagtgtataaaatttaatctctattcttcaagagatttctctatcttatgcaaggctatgggagggaaaatgacttgcgatcaacacctttgaacctgttaatcacatttgaaaatttgacattacgacggcgtttggtaatttatgcagaattgcaattgtgtgctgtttaattacgtattgttagcgttttcaaagaccagctactatttcatatgcaagtatttgaaggataaaaacattatataattcaatggaattcatttattttattttttgacgagatcaatggaattaaatttgttattcccacattcaacaccagtacattttattcatatgatataagtattgttctttcatatggtctatttatctctatagcaaatggtactggaaaactctaagtcaagatagaaaaacaggtcatctttttattggaaaagctt

SEQ ID NO: 50 - protein, 307 aa, Oryza sativa
MAGGFLSMANPAVTLSGVAGNIISFLVFLAPVATFLQVYKKKSTGGYSSVPYVVALFSSVLWIFYALVKTNSRPLLTINAFGCGVEAAYIVLYLVYAPRRARLRTLAFFLLLDVAAFALIVVTTLYLVPKPHQVKFLGSVCLAFSMAVFVAPLSIIFKVIKTKSVEFMPIGLSVCLTLSAVAWFCYGLFTKDPYVMYPNVGGFFFSCVQMGLYFWYRKPRNTAVLPTTSDSMSPISAAAAATQRVIELPAGTHAFTILSVSPIPILGVHKVEVVAAEQAADGVAAAAAADKELLQNKPEVIEITAAV

SEQ ID NO: 51 - DNA, 924 bp, Oryza sativa
atggcaggaggtttcttgtccatggctaacccggcggtcaccctctccggtgttgcaggaaacatcatctccttcctggtgttccttgcaccagtggcgacgttcttgcaggtgtacaagaagaagtcgacgggagggtacagctcggtgccgtacgtggtggcgctcttcagctcggtgctgtggatcttctacgcgctggtgaagaccaactcgaggccgctgctgaccatcaacgccttcggctgcggcgtcgaggccgcctacatcgtcctctacctcgtctacgcgccgcgccgcgccaggctccgcaccctcgccttcttcctcctcctcgacgtcgccgccttcgccctcatcgtcgtcaccaccctctacctcgtccccaagccccaccaggtcaagttcctcggcagcgtctgcctcgccttctccatggccgtcttcgtcgcccctctctccatcatcttcaaggtgatcaagaccaagagcgtcgagttcatgccgatcgggctctccgtctgcctcacgctcagcgccgtcgcgtggttctgctacggcctcttcaccaaggacccctacgtcatgtacccgaacgtgggcggcttcttcttcagctgcgtgcagatggggctctacttctggtaccggaagccgaggaacacggccgtgctgccgacgacgtccgactccatgtccccgatctccgccgccgccgccgccacgcagagggtgatcgagctccccgccggcacgcacgccttcaccatcctgtccgtgagccccatcccgatcctcggcgtgcacaaggtcgaggtggtggccgccgagcaggcggccgacggcgtcgccgccgccgccgccgccgacaaggagctgctgcagaacaagccggaggtgatcgagatcaccgccgccgtgtga

SEQ ID NO: 52 - protein, 307 aa, Oryza sativa; identical to SEQ ID NO: 50

SEQ ID NO: 53 - DNA, 924 bp, Oryza sativa; identical to SEQ ID NO: 51

SEQ ID NO: 54 - protein, 296 aa, Oryza sativa
MAGLSLQHPWAFAFGLLGNLISFTTYLAPIPTFYRIYKSKSTEGFQSVPYVVALFSAMLWIFYALIKSNEALLITINAAGCVIETIYIVMYLAYAPKKAKVFTTKILLLLNVGVFGVILLLTLLLSHGEQRVVSLGWVCVAFSVSVFVAPLSIIKRVIQSRSVEYMPFSLSLTLTLSAVVWFLYGLLIKDKYVALPNILGFTFGVVQMGLYVFYMNATPVAGEGKEGKGKLAAAEELPVVVNVGKLAAATPDRSTGAVHVHPVPRSCAAEAAAAEPEVLVDIPPPPPPRAVEVAAV

SEQ ID NO: 55 - DNA, 891 bp, Oryza sativa
atggctggcctgtccctgcagcatccctgggcttttgccttcggcctccttggcaacctcatatccttcacgacctatctggcaccaatcccgacgttctaccggatctacaagagcaagtcgacggaggggttccagtcggtgccgtacgtggtggcgctcttcagcgccatgctgtggatcttctacgcgctgatcaagtccaacgaggccctcctcatcaccatcaacgccgccggttgcgtcatcgagaccatctacatcgtcatgtacctcgcctacgcccccaagaaggccaaggtgttcacgacgaagatcctgctgctgctgaacgtgggggtgttcggggtgatcctgctgctgacgctgctgctctcccatggcgagcagcgcgtcgtctccctcggctgggtctgcgtcgccttctccgtcagcgtctttgtcgcgccgctcagcatcatcaagcgagtgatccagtcgaggagcgtggagtacatgcccttctccctctccctcacgctcaccctcagcgccgtcgtctggttcctctacggccttctcatcaaggacaaatacgtcgcgcttcccaacatcctgggcttcacattcggtgtggtccagatggggctctacgtgttctacatgaacgcgacgccggtggccggcgaggggaaagaagggaaggggaagctggcggcggcggaggagctccccgtcgtcgtcaacgtcggcaagctcgccgccgccacgcccgacaggagcaccggcgccgtgcacgtgcacccagtcccgaggagctgcgcggcggaggcggcggcggccgagccggaggtgctcgtcgacattccgccgccgccgccgccgcgcgccgtcgaggtggccgccgtgtag

SEQ ID NO: 56 - protein, 300 aa, Oryza sativa
MVQALVFAVGIVGNILSFLVILAPVPTFYRVYKKKSTESFQSVPYAVALLSAMLWLYYALLTSDLLLLSINSIGCLVESLYLTVYLLYAPRQAMAFTLKLVCAMNLALFAAVVAALQLLVKATDRRVTLAGGIGASFALAVFVAPLTIIRQVIRTKSVEFMPFWLSFFLTLSAVVWFFYGLLMKDFFVATPNVLGLLFGLAQMVLYVVYKNPKKNSAVSEAAAAQQVEVKDQQQLQMQLQASPAVAPLDVDADADADLEAAAPATPQRPADDDAIDHRSVVVDIPPPPQPPPALPAVEVA

SEQ ID NO: 57 - DNA, 903 bp, Oryza sativa
atggttcaggcattggtctttgctgtggggatcgtaggcaacatattgtcgttcttggtcatccttgcaccagtgccgacgttttatcgggtgtacaagaagaagtcgacggagtcgttccagtcggtgccgtacgcggtggcgctgctgagcgcaatgctgtggctctactacgccctcctcacctccgacctcctcctcctctccatcaactccatcggctgcctcgtcgagtccctctacctcaccgtctacctcctctacgcccccaggcaggccatggccttcaccctcaagctcgtctgcgccatgaacctcgccctcttcgccgccgtcgtcgccgccctccagctcctcgtcaaggccaccgaccgccgcgtcacgctcgccggcggcatcggcgcctccttcgccctcgccgtcttcgtcgccccgctcaccatcatcaggcaagtgatcaggaccaagagcgtggagttcatgcccttctggctctccttcttcctcaccctcagcgccgtcgtctggttcttctacggcctcctcatgaaagacttcttcgttgccacgccgaacgtgctgggattgctgtttgggctggcccagatggtgctgtacgtggtgtacaagaaccccaagaagaactccgccgtgtcggaggcggccgccgcccagcaggttgaggtcaaggaccagcagcagctgcagatgcagctccaggcgtcgccggcggtggcgccgctcgacgtcgacgccgacgccgacgccgacttggaggcggcggcgccggccaccccgcagcggccagctgacgatgacgccatcgaccacaggagcgtcgtcgtcgacatcccgccgccgccgcagccgccgccggcgctgccggccgtggaggtggcctga

SEQ ID NO: 58 - protein, 237 aa, Oryza sativa
MVMNPDAVRNVVGIIGNLISFGLFLSPLPTFVTIVKKKDVEEFVPDPYLATFLNCALWVFYGLPFIHPNSILVVTINGTGLLIEIAYLAIYFAYAPKPKRCRMLGVLTVELVFLAAVAAGVLLGAHTYDKRSLIVGTLCVFFGTLMYAAPLTIMKQVIATKSVEYMPFTLSLVSFINGICWTIYAFIRFDILITIPNGMGTLLGAAQLILYFCYYDGSTAKNKGALELPKDGDSSAV

SEQ ID NO: 59 - DNA, 714 bp, Oryza sativa
atggtgatgaaccctgacgccgtccgcaatgtcgttggaatcatcggtaacttgatatcgttcgggttgttcttgtcgccattgccgacgttcgtgacgatcgtgaagaagaaggacgtggaggagttcgtgccggatccgtacctggcgacgttcctcaactgcgcgctgtgggtgttctacggcctacccttcatccaccccaacagcatcctcgtcgtcaccatcaacggcaccggactcctcatcgagatcgcctacctcgccatctacttcgcctacgcccccaagcccaagcggtgcaggatgctcggcgtcctcaccgtggagctcgtcttcctcgccgccgtcgccgccggcgtgctcctcggcgcccacacctacgacaagcgctcgctcatcgttggcaccctctgcgtcttcttcggcaccctcatgtacgccgcgccgctcaccatcatgaaacaagtgatcgcgacaaagagcgtggagtacatgcccttcacgttgtcgctggtgagcttcatcaacggcatatgctggacaatatacgcgttcatccgctttgacatcctcatcacgataccgaacggcatggggacgctgctgggcgcggcgcagttgatcctctacttctgctactacgacgggtcgacggccaagaacaagggcgccctcgagctgcccaaggacggcgactcctccgctgtgtag

SEQ ID NO: 60 - protein, 263 aa, Oryza sativa
MVSPDLIRNVVGIVGNVISFGLFLSPVPIFWRIIKNKNVQNFKADPYLATLLNCMLWVFYVLPIVHPNSILVVTINGISLVIEAVYLTIFFLFSDKKNKKKMGVVLATEALFMAAVAVGVLLGAHTHQRRSLIVGILCVIFGTIMYSSPLTIMVVKTKSVEYMPLLLSVVSFLNGLCWTLYALIRFDIFITIPNGLGVLFAIMQLILYAIYYRTTPKKQDKNLELPTVAPIAKDTSIVAPVSNDDDVNGSTASHATINITIEP

SEQ ID NO: 61 - DNA, 723 bp, Oryza sativa
atggtgtccccggacttgatccgcaacgtggtgggcatcgtcggcaacgtcatctcctttggcctcttcctctcgccggtgcccattttctggcggatcatcaagaataagaatgtgcagaacttcaaggcggaccccatcctcgtcgtcaccatcaacggcattagcctcgtcatagaggccgtctaccttaccatcttcttcctcttctccgacaagaagaacaagaagaaaatgggagtggtgctcgctacggaggctctcttcatggcggcggtagcggtcggtgtgcttttgggcgcgcacacccatcagaggcgctctttgatcgtcggtatcctctgcgtcatctttggcaccatcatgtactcctcaccactcaccatcatggttgtgaagacgaagagcgtggagtacatgccgttgctgctatcggtggtgagcttcctcaacggcctttgctggacgttatacgcgctcatccgcttcgacatcttcatcaccatccccaatggtcttggcgtgctctttgctatcatgcaactcatcctctatgccatctactaccggaccacacccaagaagcaggataagaaccttgagctgccaaccgtcgcccccatcgccaaggacaccagcatcgtcgcccctgtcagcaatgacgacgacgtcaatggcagcactgccagccatgccaccatcaatatcacgattgaaccataa

SEQ ID NO: 62 - protein, 265 aa, Oryza sativa
MVSPDLIRNMVGIVGNIISFGLFLSPVPTFYRIIKNKDVQDFKADPYLATLLNCMLWVFYGLPIVHPNSILVVTINGIGLVIEAVYLTIFFLFSDKKNKKKMGVVLATEALFMAAVVLGVLLGAHTHQRRSLIVGILCVIFGTIMYSSPLTIMSQVVKTKSVEYMPLLLSVVSFLNGLCWTSYALIRLDIFITIPNGLGVLFALMQLILYAIYYRTIPKKQDKNLELPTVAPVAKDTSIVTPVSKDDDVDGGNASHVTINITIEL

SEQ ID NO: 63 - DNA, 1128 bp, Oryza sativa
atggtgtccccagacttgatccgcaacatggtgggcatagtcggtaacatcatctcctttggcctcttcctctcgccggtgcccaccttctaccggatcatcaagaataaggacgtgcaggacttcaaggcggacccgtacctggccacgctgctcaactgcatgctctgggttttctatggtctccctatcgtccaccccaacagcattcttgtcgtcaccatcaacggcattggccttgtcatcgaggctgtctaccttaccatcttcttcctcttctccgacaagaagaacaaaaagaagatgggagtggtgctcgctacagaggctctcttcatggcggcggtggtgctcggcgtgcttttgggcgcgcacacccatcagagacgctccttgatcgtcggcatcctctgcgtcatctttggcaccatcatgtactcctcaccactcaccatcatgagtcaggttgtgaagactaagagcgtggagtacatgccattgctgttgtcggtggaggcggagtcctacgagcggaaggtgccggagattcttccaagacaggcagtggaggggaaggggaggggggcggcgagagtcctgctcaactgtgacatactcctgctcaactgtgacatactaagccacttttgcttccattccatcagtgatcaatctgagataagcctccctgaaaatgaactccaggctctgctcctatcaattatgtttaatctttttgagattaccagtagatcactgagagaggagagtaatcacaattcgcaaaagcatcggtctgtgtcattagcaactcagcaaatgacagtggcaaacgcaaacgaggtacaaagtctaacatcaacaacaccagcactagcaaaggagcaccccctacaggtgcagcccaccaagaattttgaaagcaactctacagagtttgttattgatatagaggggccatatgatgctgaagacataacaggtcacacaacggataagacgaagttcattcttgtgaattattcaaactcttcagaagaacataagagccaagatcctacacaagatgaatcagacaacattccaaacaagagcacaaatgtatcaaacatatatcatgcattttaa

SEQ ID NO: 64 - protein, 274 aa, Oryza sativa
MVPDLIRNVVGIVGNVISFGLFLSPVPTFWRIIKNKDVRDFKADQYLATLLNCMLWVFYGLPIVHPNSILVVTINGIGLVIEAVYLTIFFLFSDKKNKKKMGVVLATEALFMAAVALGVLLDAHTHQRRSLIVGILCVIFGTIMYSSPLTIMSQVVKTKSVEYMPLLLSVVSFLNGLCWTSYALIRFDIFITIPNGLGVLFALMQLILYAIYYRTTPKKPSTTGPHPRSRIRTSSYQPSPPSPRAPASSPLSARTTTSMAAMSPSISRLSHKLA

SEQ ID NO: 65 - DNA, 237 bp, Oryza sativa
atggttttctatggtcttcccatcgttcaccccaacagcattctcgtcgtcaccatcaacggtattggcctcgtcatcgaggccgtctacctcaccatcttcttcctcttctccgacaagaagaacaagaagaagatgggagtggtgctcgctacggaggctctcttcatggcggcggtggcgctcggcgtgcttttagacgcgcacacccatcagagacgatcaagcgctccttga

SEQ ID NO: 66 - protein, 256 aa, Oryza sativa
MVSPDLIRNVVGIVGNAISFGLFLSPVLTFWRIIKEKDMKYFKADPYLATLLNCMLWVFYGLPIVHPNSILVVTINGIGLVIEAVYLTIFFLFSNKKNKKMGVVLATEALFMAAVALGVLLGAHTHQRRSLIVGILCVIFGTIMYSSPLTIMSQVVKTKSVEYMPLLLSVVSFLNGLCWTSYALIRFDIFITIPNGLGVLFTLMQLILDKNQDKNLELPTVAPVAKETSIVTPVSKDDDINGSTASHVIINITKEP

SEQ ID NO: 67 - DNA, 297 bp, Oryza sativa
atggtgtccccggacttgatccgcaacgttgtgggcatcgttggcaatgccatctcctttggcctcttcctctcgccggtgctcaccttctggcggatcatcaaggagaaggacatgaaatactttaaggcggacccgtacttggccacgctgctcaactgcatgctctgggtcttctatggtctccccatcgtccatcccaacagcatcctcgtcgttaccatcaacggcattggcctcgtcatcgaggccgtctacctcaccatcttcttcctcttctccaacaagaagaactag

SEQ ID NO: 68 - protein, 264 aa, Oryza sativa
  misc_feature (40)..(40): Xaa can be any naturally occurring amino acid
MVSPDMIRNVVGIVGNVISFGLFLSPVPTFWQIIKNKNVXDFKTDPYLATLLNCMLWDFYGLPIVHPNSILVVTINGIGLVIEAVYLTIFFLFSDKKNKKKMEVVLAAEALFMAAVALGVLLGVHTHQRRSLIVGILCVIFDTIMYSSPLTVMSQVVKTKSVEYMPLLLSVVSFLNGLYWTSYTLIRFDIFITIPNGLGVLFAAVQLILYVIYYRTTPKKQNKNLELPTVTPVAKDTSVGPISKDNDLNGSTASHVTIDITIQP

SEQ ID NO: 69 - DNA, 621 bp, Oryza sativa
atggtgtccccggacatgatccgcaacgtggtgggcatcgtcggcaacgtcatctcctttggcctcttcctctcgccggtccccaccttctggcaaatcatcaagaataagaacaagaacaagaagaagatggaagtggtgctagcggcggaggctctcttcatggcggcggtggcgcttggcgtactcttaggcgtgcacacccatcaaagacgctccttgatcgtcggcatcctctgcgtcatctttgacaccatcatgtactcctcaccactcaccgtcatgagtcaggttgtgaagacgaagagcgtggagtacatgccactgctactatcggtggtgagcttcctcaacggcctctactggacatcatacacgctcatccgcttcgacatcttcatcaccatccctaatggtcttggcgtgctcttcgctgccgtgcagctcatcctctatgtcatctactaccggaccacacccaaaaagcagaacaagaacctcgagctgccaaccgtcacccctgtcgccaaggacaccagcgtcggccctatcagcaaggacaacgacctcaacggcagcactgccagccatgtcaccatcgatatcactatccagccataa

SEQ ID NO: 70 - protein, 254 aa, Oryza sativa
MISPDAARNVVGIIGNVISFGLFLSPVPTFWRICKRKDVEQFKADPYLATLLNCMLWVFYGIPIVHPNSILVVTINGIGLIVEGTYLFIFFLYSPNKKRLRMLAVLGVELVFMLAVILGVLLSAHTHKKRSMIVGILCVFFGSIMYFSPLTIMGKVIKTKSVEYMPFFLSLVCFLNGVCWTAYALIRFDIYVTIPNGLGAIFGAIQLILYACYYRTTPKKTKAAKDVEMPSVISGPGAAATASGGSVVSVTVER

SEQ ID NO: 71 - DNA, 765 bp, Oryza sativa
atgatctccccggacgcggctcgcaacgtcgtcggcatcatcggcaatgtcatctccttcggcctcttcctctcccccgtgccgacgttctggaggatctgcaagaggaaggacgtggagcagttcaaggcggacccgtacctggcgacgctgctcaactgcatgctatgggtgttctacggtatccccatcgtccacccgaacagcatcctcgtcgtcaccatcaacggcatcggtctcattgtcgagggcacctacctcttcatcttcttcctctactcccccaacaagaagcgcctgaggatgttggctgtgctgggcgtggagttggtgttcatgctggcggtgattctgggcgtgcttctgagcgcgcacacgcacaagaagcgttccatgatcgtcggcatcctctgcgtcttcttcggctccatcatgtacttctccccgctcaccatcatggggaaagtgataaagacgaagagcgtagagtacatgccgttcttcctgtcgctggtgtgcttcctcaacggcgtttgctggacggcctacgcgctcatccgcttcgacatctatgtgaccatccccaacggcctcggtgccatcttcggtgccatccagctcatcctctacgcctgctactaccggaccacacccaagaagaccaaggccgccaaggacgtcgagatgccctccgtcatctccggtcccggtgccgccgccaccgccagtggcggcagtgtcgtctccgtcaccgtcgagcgataa

SEQ ID NO: 72 - protein, 259 aa, Oryza sativa
MISPDAARNVVGIIGNVISFGLFLAPVPTFWRICKRKDVEEFKADPYLATLLNCMLWVFYGIPVVHPNSILVVTINGIGLLVEGTYLLIFFLYSPNKKRLRMCAVLGVELVFMLAVILGVLLGAHTHEKRSMIVGILCVFFGSIMYFSPLTIMGKVIKTKSVEYMPFFLSLVCFLNGVCWTAYALIRFDIYVTIPNGLGALFGAIQLILYACYYRTTPKKTKAAKDVEMPSVVVSGTGAAAAAGGGNTGGGSVSVTVER

SEQ ID NO: 73 - DNA, 780 bp, Oryza sativa
atgatctccccggacgcggctcgcaacgtcgtcggcatcatcggcaatgtcatctccttcggcctcttcctcgcccccgtgccgacgttctggaggatctgcaagaggaaggacgtggaggagttcaaggcggacccatacctagcgacgctgctcaactgcatgctctgggtgttctacggcattcccgttgtccaccccaacagtatcctcgtcgtcaccatcaacggcatcggcctcctcgtcgagggcacctacctcctcatcttcttcctctactcccccaacaagaaacgcctgaggatgtgtgctgtgctgggcgtggagttggtgttcatgttggcggtgattctgggtgtgctgctgggcgcgcacacccacgagaagcgctccatgattgtcggtatcctctgcgtcttcttcggctccatcatgtacttctcccctctcactatcatggggaaagtgataaagacgaagagcgtggagtacatgccgttcttcctgtcgctggtgtgcttcctcaacggcgtctgctggacggcctacgcgctcatccgctttgacatctacgtgaccatccccaatggtctcggcgccctcttcggcgccatccagctcattctctatgcttgctactaccggaccacacctaagaagaccaaggccgccaaggacgtcgagatgccctccgtcgttgtctccggcaccggcgccgccgccgctgccggtggcggtaacaccggcggcggcagcgtctccgtcaccgtcgagcgatga

SEQ ID NO: 74 - protein, 259 aa, Oryza sativa
MVSPDTIRTAIGVVGNGTALVLFLSPVPTFIRIWKKGSVEQYSAVPYVATLLNCMMWVLYGLPAVHPHSMLVITINGTGMAIELTYIALFLAFSLGAVRRRVLLLLAAEVAFVAAVAALVLNLAHTHERRSMIVGILCVLFGTGMYAAPLSVMKMVIQTKSVEYMPLFLSLASLVNGICWTAYALIRFDLYITIPNGLGVMFAVAQLILYAIYYKSTQQIIEARKRKEADHVAMTDVVVDSAKNNPSSGAAAAAANGRY

SEQ ID NO: 75 - DNA, 780 bp, Oryza sativa
atggtctcgccggacaccatccgcacggccatcggcgtcgtaggcaatggaaccgccctcgtgctcttcctctccccagtgccgacgttcatacggatctggaagaaggggtcggtggagcagtactcggcggtgccgtacgtggcgacgctgctcaactgcatgatgtgggtgctgtacggcctccccgcggtgcacccgcacagcatgctggtcatcaccatcaacggcaccggcatggccatcgagctcacctacatcgccctcttcctcgccttctccctcggcgccgtccgccgccgcgtcctcctcctcctcgccgccgaggtcgccttcgtcgccgccgtcgccgccctcgtcctcaacctcgcccacacccacgagcgacgctccatgatcgtcggtatcctctgcgtcctcttcggcaccggcatgtacgccgcccccctctccgtcatgaaaatggtgatccagactaagagcgtggagtacatgccccttttcttgtccctggcgtcactggtcaacggcatctgctggactgcctacgccctcatccgcttcgacctctacatcacgatccccaacgggctgggagtgatgttcgcggtggcgcagctgatcctgtacgccatctactacaagtcgacgcagcagatcatcgaggcgcgcaagcgcaaggaggccgaccatgtcgccatgaccgatgtcgtcgtcgactccgccaagaacaacccctcctccggcgccgccgccgccgccgccaacggccgctactag

SEQ ID NO: 76 - protein, 261 aa, Oryza sativa
MEDLAKFLFGVSGNVIALFLFLSPVPTFWRIIRRKSTEDFSGVPYNMTLINCLLSAWYGLPFVSPNNILVSTINGAGAVIETAYVVVFLVFASTHKTRLRTLGLAAAVASVFAAVALVSLLALHGQHRKLLCGVAATVCSICMYASPLSIMRLVIKTKSVEYMPFLMSLAVFLCGTSWFIYGLLGRDPFVTIPNGCGSFLGAVQLVLYAIYRNNKGAGGGSGGKQAGDDDVEMAEGRNNKVADGGAADDDSTAGGKAGTEV

SEQ ID NO: 77 - DNA, 786 bp, Oryza sativa
atggaggatttggcaaagttcttgtttggagtttctggcaatgtcatcgcgctcttcctcttcttatccccagtgcctactttctggaggatcattcggaggaaatcaacagaggatttctctggggtgccatacaacatgacactcatcaactgcctcctctctgcatggtacgggctgccgttcgtgtccccaaacaacatcctggtgtcgacgatcaacggcgccggcgcggtgatcgagacggcgtacgtggtggtgttcctcgtgttcgcctccacccacaagacgcggctgcgcacgctcggcctcgccgcggccgtcgcgtcggtgttcgcggcggtggcgctcgtctccctcctcgccctccacggccagcaccgcaagctcctctgcggcgtcgccgccaccgtctgctccatctgcatgtacgcctcccccctctccatcatgaggctggtgatcaagacgaagagcgtggagtacatgccgttcctgatgtcgctggccgtgttcctgtgcggcacgtcgtggttcatctacggcttgctcggccgcgaccccttcgtcacgattccgaacgggtgcgggagctttcttggcgccgtgcagctggtgctctacgccatctaccgcaacaacaagggcgccggcggcggcagcggcggcaagcaggccggcgacgacgacgtggagatggccgaggggaggaacaacaaggtcgccgacggcggcgccgccgacgacgactcgacggccggcggcaaggcgggcaccgaagtgtag

SEQ ID NO: 78 - protein, 273 aa, Oryza sativa
MEHIARFFFGVSGNVIALFLFLSPVVTFWRIIKKRSTEDFSGVPYNMTLLNCLLSAWYGLPFVSPNNILVTTINGTGSVIEAIYVVIFLIFAERKARLKMMGLLGLVTSIFTMVVLVSLLALHGQGRKLFCGLAATIFSICMYASPLSIMRLVIKTKSVEFMPFLLSLSVFLCGTSWFIYGLLGRDPFIAIPNGCGSFLGLMQLILYAIYRNHKGATPAAAAGKGDAADEVEDAKKAAAAVEMADAKTNKVVADDADADADGKSADDKVASQV

SEQ ID NO: 79 - DNA, 822 bp, Oryza sativa
atggagcacatcgcgaggttcttctttggagtttccggcaatgtcatcgctctcttcctgttcctttcgccagttgtcaccttctggaggatcatcaagaagagatcaacggaggacttctccggcgtgccttacaacatgacacttctcaactgcctgctatctgcttggtacgggctgccgttcgtgtcaccgaacaacatcctggtgacgacgatcaacgggacggggtcggtgatcgaggccatctacgtggtgatcttcctcatcttcgcggagaggaaggccaggctgaagatgatgggtctcctgggcctcgtcacctccatcttcaccatggtggtgctcgtctccctcctggccctgcacggccagggccgcaagctcttctgcggcctcgccgccaccatcttctccatctgcatgtacgcctcgcctctctccatcatgaggctggtgatcaagacgaagagcgtggagttcatgccgttcctgctctccctgtccgtgttcctgtgcggcacctcctggttcatctacggcctgctcggccgcgaccctttcatcgcgatccccaatggatgcgggagctttctgggcttgatgcagctgatcctctacgcgatctaccggaaccacaagggggccacgccggcggcggcggccgggaagggggacgccgccgacgaggtggaggacgcgaagaaggcggccgccgcggtggagatggccgacgccaagaccaacaaggtcgtcgccgacgacgccgacgccgacgccgatggcaagtcggcggacgacaaggtcgccagccaggtgtga

SEQ ID NO: 80 - protein, 230 aa, Oryza sativa
MDSLYDISCFAAGLAGNIFALALFLSPVTTFKRILKAKSTERFDGLPYLFSLLNCLICLWYGLPWVADGRLLVATVNGIGAVFQLAYICLFIFYADSRKTRMKIIGLLVLVVCGFALVSHASVFFFDQPLRQQFVGAVSMASLISMFASPLAVMGVVIRSESVEFMPFYLSLSTFLMSASFALYGLLLRDFFIYFPNGLGLILGAMQLALYAYYSRKWRGQDSSAPLLLA

SEQ ID NO: 81 - DNA, 693 bp, Oryza sativa
atggactccttgtatgatatctcctgctttgctgctggtcttgcaggcaacatctttgcgcttgctctcttcctgtcgccagtgacgacgtttaagaggatcctgaaggccaaatcgaccgagcgattcgacgggctcccttacctgttctcgctgctgaattgcctcatctgcctgtggtatggacttccctgggtcgccgatggcaggctgctcgtcgctaccgtcaacggcattggagcggtgttccagctcgcctacatttgcctcttcatcttctacgcggacagcaggaagacgaggatgaagatcatagggctcttggtgctggtagtttgcgggtttgcgctagtttcacatgcgagcgtctttttctttgatcaaccgcttcggcagcagtttgtgggagctgtgagcatggcttcgctgatctccatgttcgcttctccgttagctgtcatgggagttgtgattcggtcagagtctgtggagttcatgccgttctatctgtcactctctacgttcttgatgagcgccagttttgcattgtatgggttgctgctgcgagatttcttcatttatttccctaatgggcttggacttatcctgggagcaatgcagctggcgctctacgcttactacagcagaaaatggagaggccaggattcatctgcaccgttgctgctcgcatga

SEQ ID NO: 82 - protein, 243 aa, Oryza sativa
MMNALGLSVAATSTGSPFHDVCCYGAGIAGNIFALVLFISPLPTFKRIVRNGSTEQFSAMPYIYSLLNCLICLWYGLPFVSYGVVLVATVNSIGALFQLAYTATFIAFADAKNRVKVSSLLVMVFGVFALIVYVSLALFDHQTRQLFVGYLSVASLIFMFASPLSIINLVIRTKSVEYMPFYLSLSMFLMSVSFFAYGVLLHDFFIYIPNGIGTVLGVIQLVLYGYFRKGSREDSLPLLVTHT

SEQ ID NO: 83 - DNA, 732 bp, Oryza sativa
atgatgaacgctctcggtttatcggtggcggccaccagcaccggctcccccttccacgacgtctgctgctatggcgctgggattgcagggaacatcttcgctcttgtgctcttcatctccccgctgccgacgttcaagaggatcgtccggaacggatcgacggagcagttctcggcgatgccgtacatttactcgctactcaactgcctcatctgtctctggtacggcctccccttcgtctcctacggcgtcgtcctcgtcgccaccgtcaactccatcggcgccctcttccagctcgcctacaccgccaccttcatcgcattcgccgacgccaagaacagggtgaaggtgtccagcctgctggttatggtgttcggcgtgttcgctctaattgtgtatgttagtctggcgttgtttgatcaccaaacacggcaattgttcgtcggttacctcagcgttgcgtccctcatattcatgtttgcgtcccccttgtccatcattaatctggtgatcaggacgaagagcgtggagtacatgcccttctatttgtcactctctatgttcttgatgagcgtatcgttcttcgcatatggagttctactgcatgatttcttcatatatattccaaatgggattggaaccgttttgggtgtcattcaattggtgctctatggctacttcagaaaaggatcaagagaggacagcctcccattgctagtcacacatacatga

SEQ ID NO: 84 - protein, 252 aa, Oryza sativa
MVSNTIRVAVGILGNAASMLLYAAPILTFRRVIKKGSVEEFSCVPYILALFNCLLYTWYGLPVVSSGWENSTVSSINGLGILLEIAFISIYTWFAPRERKKFVLRMVLPVLAFFALTAIFSSFLFHTHGLRKVFVGSIGLVASISMYSSPMVAAKQVITTKSVEFMPFYLSLFSFLSSALWMIYGLLGKDLFIASPNFIGCPMGILQLVLYCIYRKSHKEAEKLHDIDQENGLKVVTTHEKITGREPEAQRD

SEQ ID NO: 85 - DNA, 759 bp, Oryza sativa
atggtttccaacacaatccgtgtagcagtaggaattctaggaaatgctgcttccatgctcctgtatgcagcacctatattaacatttaggagggtgatcaagaagggcagtgtagaagaattctcttgtgttccatacatcttagctctgttcaactgcctcctgtacacatggtatgggcttcctgtagtaagctcaggatgggagaattctacagtgtcttccatcaatgggcttggcatactgcttgagatcgcattcatcagcatatacacatggtttgcacccagagaaagaaagaagtttgtgttgcgaatggtgctacccgttcttgcattctttgcgctgacagcaattttttcaagctttctgtttcatacgcacggtttacgcaaagtttttgtgggtagtattggcctggtggcttccatatcgatgtacagctctccaatggtagctgcaaaacaagtcataacaacaaaaagtgtggagttcatgcccttctacctgtcattgttttccttcctctccagtgctctatggatgatatatgggcttctagggaaggatctcttcatcgcgtcaccaaacttcattggctgtccaatgggtatccttcagttggtcctgtactgcatttacaggaaaagccacaaggaagctgaaaagcttcatgacatcgaccaggaaaatggtctgaaagtggtaaccacgcatgagaagataactggaagggagccagaggctcagagagattga

SEQ ID NO: 86 - protein, 252 aa, Oryza sativa; identical to SEQ ID NO: 84

SEQ ID NO: 87 - DNA, 759 bp, Oryza sativa; identical to SEQ ID NO: 85

SEQ ID NO: 88 - protein, 246 aa, Oryza sativa
MFPDIRFIVGIIGSVACMLLYSAPILTFKRVIKKASVEEFSCIPYILALFSCLTYSWYGFPVVSYGWENMTVCSISSLGVLFEGTFISIYVWFAPRGKKKQVMLMASLILAVFCMTVFFSSFSIHNHHIRKVFVGSVGLVSSISMYGSPLVAMKQVIRTKSVEFMPFYLSLFTLFTSLTWMAYGVIGRDPFIATPNCIGSIMGILQLVVYCIYSKCKEAPKVLHDIEQANVVKIPTSHVDTKGHNP

SEQ ID NO: 89 - DNA, 741 bp, Oryza sativa
atgtttcctgatatacgttttattgtgggaattataggatctgtagcttgcatgctcctctactcagcaccaatattgacatttaaaagagtgataaagaaggccagtgtagaagaattctcgtgcataccatatatcttagctttgttcagctgcctcacatacagttggtatggttttcctgtggtgagctatgggtgggagaacatgacagtctgcagcatcagctcacttggggtgctatttgaaggcacattcatcagcatatatgtatggtttgctccaagaggaaaaaaaaagcaagtcatgctgatggcatctctgattctagcagtcttttgcatgactgtgtttttctcaagcttttcaatacacaaccatcatatacgtaaggtatttgttggtagtgttggtctagtgtcttccatatcaatgtacggctctccgctggtagctatgaaacaagttatcaggacaaagagtgttgagttcatgcctttctatctgtcattgtttaccctcttcacaagtttaacctggatggcatatggagtcataggaagggatccttttatcgcgaccccaaactgcatcggcagcataatgggtatacttcagttggttgtatactgcatttacagcaaatgcaaggaagcacctaaggtgcttcacgatattgaacaagcaaatgtagtgaaaattccaacaagtcatgtggacacaaaagggcataacccttaa

SEQ ID NO: 90 - protein, 11 aa, Artificial
  Synthetic sequence
EQDRNYWLLQT

SEQ ID NO: 91 - protein, 84 aa, Chlorobium phaeobacteroides
MHNPDYLGFAAGILTTLAFLPQAVRMLKTKRTRDISLLWAIAMNAGTMLWLTYGIIKNDLPMITANSISLVLLMVILISRLRYR

SEQ ID NO: 92 - protein, 113 aa, Desulfovibrio vulgaris
MPDTLDLIGYAAGLLTSLAYVPQVVRLWRTRSVADISLPTFCLLTVGIGLWLLYGMGREAGPVIVANAVGMLLTLAIVVMKLWFGRHSAQATDEGIGHPVRQDAAKPHLRRDA

SEQ ID NO: 93 - protein, 84 aa, Cyanothece sp. CCY0110
MNSITWIGLLAGTLTTISFFPQMLKTWKTRSTKDISLEMFLLFCSGLLLWIIYGLFMRDIPVIMTNIATFVLAFPILILKLKYK

SEQ ID NO: 94 - protein, 84 aa, Flavobacteriales bacterium HTCC2170
METIELLGLIAATCTTFAFIPQVYKVWQEKSAKDISLTMYLVMTLGLALWLIYGINIDSLPVILANGITLVLVLFMVFLKLKHK

SEQ ID NO: 95 - protein, 83 aa, Bradyrhizobium sp. (strain BTAi1 / ATCC BAA-1182)
MLTTLIGLGAATCTTCSFLPQVIKAWRSRSTQDISAGMFVLLTTGNAMWLLYGALINDLPLVVANLITLALVATILGLKLRYG

SEQ ID NO: 96 - protein, 86 aa, Flavobacterium johnsoniae
MNFIDIIGLFAGACITLSTVPQIVKVWKTKKVKDISLKTFSILTFGIIVWIIYGILKEDLPIIITNSVSLCLNLIMIYFIITYKKE

SEQ ID NO: 97 - protein, 135 aa, Geobacter uraniireducens
MTMLKRGSIDRTTRGVVLLSVIMLCGCKEFAVHDTSSLLIPRFQRSEVLGFVAGFGTTFAAMPDLIKMIKRRSSKGINPTMAGIMGVFQIVWIYYGLLIASRPVIVWNLAAVVINSMTVWAYFRFARIERNQAKE

SEQ ID NO: 98 - protein, 88 aa, Legionella pneumophila
MSIVIFSGIVAFITSFIGLLPQIVKSLKTKSTEDLSMMMLVNYLVCSLAWIIYGSSTNSFFVTSSNVVGLIVSFLLILLKRRYDARCN

SEQ ID NO: 99 - protein, 79 aa, Streptococcus gordonii
MIGSIAAVLTTFAFLPQVIKVIKTKDTESIALGMYLMQVLGIALWLAHGLAIQDLPLILANSVSFILSGIILVYKIRYK

SEQ ID NO: 100 - protein, 85 aa, Leptospira biflexa serovar Patoc
MENLIGYVAAFLTTVSFLPQVLRVVMTKQTRDISRNMYIMFFLGVVLWFVYGILRSDLPIILANVVTLFFVTIILYYKLTEGNQT

SEQ ID NO: 101 - protein, 85 aa, Leptospira biflexa serovar Patoc; identical to SEQ ID NO: 100

SEQ ID NO: 102 - protein, 86 aa, Leuconostoc citreum
MKAKIHNFVGSIGALIGTFVFIAYIPQIMANLAGDKGQPWQPLVAAFSCLLWVIYGFTNTPKRDYILITPNLAGVVLGTITFITSL

SEQ ID NO: 103 - protein, 86 aa, Leuconostoc citreum
MRNQKLVQYLSWTATVMSIMMYISYVPQIINNLSGAKGNPIQPLVAGINCTLWVIYGLIKEKRDLPLAAANFPGIIFGIITFWTAL

SEQ ID NO: 104 - protein, 84 aa, Cyanothece sp. (strain ATCC 51142)
MNSITWIGLLAGTLTTISFFPQMLKTWKTRSTKDISLEMFLLFCSGLLLWIIYGLFMRDIPVIMTNVATFILAFPILILKLKYK

SEQ ID NO: 105 - protein, 86 aa, Chlorobium limicola
MEFASSEAVGFAAGIVTTLSLLPQAVKIMTTRRTRDISLLWAISMNIGILLWLFYGIVKNDMPMITANSISFVLLFLILIFKLRFR

SEQ ID NO: 106 - protein, 90 aa, Geobacter bemidjiensis
MTLVGTLGFCAGLLTSGAAVPQVYKTYKTRHARDISMWQLVMLSLGMLLWLIYGSMIGDLPLILANTFSIACYASLIAMKLRYDREDRTS

SEQ ID NO: 107 - protein, 88 aa, Thermodesulfovibrio yellowstonii
MEFSIDLNNLIGIIAGAITTSALIPQALKIYKTKSARDVSLAMFIFMAIGITLWFFYGVLIKEIPVILANLISLILIFLIIFMKIRYG

SEQ ID NO: 108 - protein, 105 aa, Rhodospirillum centenum
MPADPLSQSALSAPAFSAAGLTEMIGYGAATLTTVAFLPQAVKIWRTRSARDVSLPTFALFTLGVLLWLAYGLLLGAWPVILANTVTLGLSVLILLMKLRFDREA

SEQ ID NO: 109 - protein, 94 aa, Cytophaga hutchinsonii
MDWIVVTGVCASMCTALSLLPQLIKVLRTKKAEDVSYLMLAVLFTGGILWIVYGVMREDWIIIGSNTISVLINIISCWASIKYRPKDKMIKELM

SEQ ID NO: 110 - protein, 105 aa, Geobacter metallireducens
MNGEIMLGLVAGAVTSIAVVPQVARAYRTKRVRDISVWQPVILVAGMILWLTYGVMIGDIPLIAANIFSIACNGILIGMKFCYRGGDNGADGGYSLGQTNQTEDL

SEQ ID NO: 111 - protein, 84 aa, Pelodictyon luteolum
MHQSEYIGYAAGIITTLALFPQAIKILSTRHTRDISLIWALAMNAGIILWLLYGIAQNDLPMIAANGCSLILLMIILLLKLRYG

SEQ ID NO: 112 - protein, 88 aa, Legionella pneumophila
MSIVIFSGIVAFITSFIGLLPQIVKSLKTKSTEDLSMMMLVNYLVCSLAWIIYGSSTNSFFVTSSNVVGLIVSSLLILLKRRYDARCN

SEQ ID NO: 113 - protein, 88 aa, Legionella pneumophila; identical to SEQ ID NO: 98

SEQ ID NO: 114 - protein, 96 aa, Leptospira interrogans serogroup Icterohaemorrhagiae serovar copenhageni
MDSITFLGYIASLLTTISFLPQLIRILMGGSTKDISRNMYIVLVTGVFLWFIYGCLKQDFPIILANAFTFLFAATILYFKLKSDSKVKLKNKSNEE

SEQ ID NO: 115 - protein, 113 aa, Desulfovibrio vulgaris; identical to SEQ ID NO: 92

SEQ ID NO: 116 - protein, 86 aa, Bradyrhizobium japonicum
MDPFLIKLIGFAAATCTTVAYAPQFIKVLKTRSARDISLGMFLVMVLGLALWLIYGLLSGDAPLIASNAVTMLLAGGILVMKLRYG

SEQ ID NO: 117 - protein, 96 aa, Leptospira interrogans; identical to SEQ ID NO: 114

SEQ ID NO: 118 - protein, 22 aa, Artificial
  Synthetic sequence
HKTMLPLPLIPSLLLSLSSAEF

SEQ ID NO: 119 - protein, 15 aa, Artificial
  Synthetic sequence
QPSLKRMKIQPSSQP

SEQ ID NO: 120 - protein, 7 aa, Artificial
  Synthetic sequence
MGSSKSK

SEQ ID NO: 121 - protein, 5 aa, Artificial
  Synthetic sequence
  MISC_FEATURE (2)..(2): X is any amino acid
  MISC_FEATURE (4)..(5): X is any amino acid
KXKXX

SEQ ID NO: 122 - protein, 7 aa, Artificial
  Synthetic sequence
PKKKRKV

SEQ ID NO: 123 - protein, 28 aa, Artificial
  Synthetic sequence
MSVLTPLLLRGLTGSARRLPVPRAKISL

SEQ ID NO: 124 - protein, 7 aa, Artificial
  Synthetic sequence
MMTVLTR

SEQ ID NO: 125 - DNA, 21 bp, Artificial
  Synthetic sequence
  misc_feature (21)..(21): n is a, c, g, or t
trcactccattactrtaaaan

SEQ ID NO: 126 - DNA, 22 bp, Artificial
  Synthetic sequence
  misc_feature (5)..(5): n is a, c, g, or t
  misc_feature (11)..(11): n is a, c, g, or t
  misc_feature (14)..(15): n is a, c, g, or t
  misc_feature (22)..(22): n is a, c, g, or t
taaancrcccnccnnrratran

SEQ ID NO: 127 - protein, 299 aa, Caenorhabditis elegans
MLEVVLQVLSISAITTTIALFFCGIPICMQIRRQGAVGDISGVPFLMGVLGGSFWLRYGLLKMDYVMIIVNVVGVACMAFYCVFFLIYSLPKKTFTCQLILVTSTIGGMVLWIALKPNLDYLGVICMTFNIMNFGAPLAGLGVVLKNREVSTLPLPMCVANFLVSSQWCLYGNLVSDIYIIIPNGIGMFLAIVQLALFVVLPIRENEKSPLEKLASWFTGRDSKVKDLERGDCIVSSPPSSPQKVPNETRSDVEDKFDKLMAETSSTIPSDSRRGSMGSPPSYKSRSSSDPDLSSIQSP

SEQ ID NO: 128 - protein, 233 aa, Caenorhabditis elegans
MDTFFPIIFSTELKKPICLQIYRQGHVGDISGFPFLMGTLVLPFWLRYGFLRNDVMLISINCAGIPIAVFNAMFFLYFSKPKKYYMTQLSIVTIIILTMLMLIHFNPNVQFLGFVCIVLNLITFGSPLAGLRVVLRDREVITLPFVLCLVQLIVQCLWNLYGILIQDFFLVIPTAVGIMISLVQLSLFLIFPRKRDGYSPMAKVARCVFGSSNNRKEVPDEPQKIVVESNTVY

SEQ ID NO: 129 - protein, 355 aa, Caenorhabditis elegans
MFEIFTQGFSLLNLLSILAFFTTVGLFFCGIPICRQIWKRKDTKEISGAPFLMGVVGGCCWMTYGWLKNDGTVKWVTGCQVILYTTYTIFYWCMTKKKLYISLKVLGVIGICTSLVLAVHFFGMKIFHPLGIVCLTLNIADFAAPLGGIRVVIRRWATSTLPLPLCIANFLVSTEWFLYGLLKNDFYLIFPNGVGSLLAFIQLLLFIVLPRKPGQRAPIVRLWLWIRGVRVEETKEIVAELGECDEKDDKKMNRAQRWSQKIKMNVSTVAEELENVIYQLPTKDQFAYTHKIGDEDSSSEKTVETVDETKKAPVTAVDKLKDADRERKMRNALRAAQDARENALRRTISSPDLSE

SEQ ID NO: 130 - protein, 221 aa, Rattus norvegicus
MEAGGVADSFLSSACVLFTLGMFSTGLSDLRHMQRTRSVDNIQFLPFLTTDVNNLGWLSYGVLKGDGTLIIVNTVGAVLQTLYILAYLHYSPQKHAVLLQTATLLAVLLLGYGYFWLLVPDLETRLQQLGLFCSVFTISMYLSPLADLAKIIQTKSTQRLSFSLTIATLLSSTSWSIYGFRLKDPYITVPNLPGILTGFIRLVLFYKYPPEQDTKYRLLQT

SEQ ID NO: 131 - protein, 221 aa, Homo sapiens
MEAGGFLDSLIYGACVVFTLGMFSAGLSDLRHMRMTRSVDNVQFLPFLTTEVNNLGWLSYGALKGDGILIVVNTVGAALQTLYILAYLHYCPRKRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 132 - protein, 216 aa, Xenopus laevis
MDWMWLLSGACIVFTLGMFSSGLSDLRVMVAQRSVENIQYLPFLTTDLNNLGWFYYGYLKGDGTLMIVNVIGASLQSLYMGAYLLYSPERRYVGSQVLVSLGVLLLGYCYFTLWILDLNSRLNQLGLFCSVFTISMYLSPLADLAQIIRSKSTKCLSFPLTVATFLTSSSWVLYGLVQSDLYITVPNFPGIVTSLVRFWLFSQFPPDPPTYRLLQA

SEQ ID NO: 133 - protein, 202 aa, Danio rerio
MFTTGLTDLKKMKATQSADNVQFLPFLTTCLNNLGWLYYGLLKGDGTVIFVNIIGAFLQTVYIATYCHYTKEKRRVYTQTLLMVSVLCVAWVYFSLVISPGEAQLSQLGLTCSVFTISMYLSPLADLLDIMRTKSVERLSFSLTVATFFTSTSWTLYGLQLGDYYIMVPNTPGIFTSLIRFFLFWWFGAVIPQIPSYKLIQI

SEQ ID NO: 134 - protein, 216 aa, Ciona intestinalis
  misc_feature (216)..(216): Xaa can be any naturally occurring amino acid
MAEFWISFFSNGCIAVTIIMFATGIPQCMEMMKKKTTKNIPFLPYLITNVNAIGWIIYGKMTVNFTVVFVNTIGAGLQTLYMAVYIFFAADKSKPLVQSSVCGGAAAITWYIITQFANVIDAINVTGIICCTVTIFMFASPLAEINTVIANKSTATISLPLTVTASLCSAMWTMFGLVLHDNFIIIPNVLGFFAAFSRFYLFYKYPSSPGLPHSVX

SEQ ID NO: 135 - protein, 268 aa, Medicago truncatula; identical to SEQ ID NO: 35

SEQ ID NO: 136 - protein, 269 aa, Medicago truncatula; identical to SEQ ID NO: 31

SEQ ID NO: 137 - protein, 288 aa, Medicago truncatula
MAMISMNHHFLVIAFGLLGNIISCMVYLAPLPTFIQIYKKKSTECFQSLPYLVALFSSMLWLYYGIQTNAIFIVSINAFGCVIEIIYCIMYIAYATKDARKLTIKLCAALNVVSFVLIFLIIQFSIPENHRVQVLGWICTSISISVFAAPLSIVVRVVKTKSVEFMPFNLSLFLTLSAVVWFLYGFVKRDICIYLPNVVGFILGIIQMVLYGYYSKYSVEKEKEQAVINIVVVNPLGSSEVFPIPLDENKESIEDVINQQFQVKKVGEEDAKEKHDNNVEAIEFQCVV

SEQ ID NO: 138 - protein, 311 aa, Medicago truncatula
MSSHHSHLSFAFGVLGNISSFVCFLAPLPTFYRICKKKSTEGFQSIPYVAALFSAMLWMFYAYTKKGETLLITINAFGCVIETIYLAVFVTYCPKKVRMSTLRMIVLMNFVGFGTIVLLTHFLAKQEEGRIKLLGWICVVFATSVFAAPLSIIRVVIRTKSVEFLPFPLSVLLLISAVMWLLYGLSLRDIYVTLPNVVGLTFGIVQITLYAMYRNSKPVIDEKLPEHKGDIVDKEIENVVVPSKTTNDEKKLEVSVVDMVIVEKKEEKQDEEHDEKEKKQDQVTQDKTKVKNENDNININKTEEKDSGCEV

SEQ ID NO: 139 - protein, 257 aa, Medicago truncatula
MVTKMVWLDPNEVNEISMDNSRIVTFMSFLAPLPTFYSIYKKKSSEGFHSIPYVVTLLSTLLFVYYGFLKTNAIFLITINSIGCVMEVAYLIMYITYAPKKLKISTLVLILIVDMGGFGLTMIITTFIVKGSFHVQVVGMICTIFNIGMFAAPLSIMKKVIKTRSVEYMPFPLSLFLTICATMWFFYGFFDKDKYIMLPNGLGFLLGVSQMILYLIYKNAKNNVEASSTNQLQEHGCDGGNNQIFPTVVEMKEINIV

SEQ ID NO: 140 - protein, 300 aa, Oryza sativa; identical to SEQ ID NO: 56

SEQ ID NO: 141 - protein, 236 aa, Medicago truncatula; identical to SEQ ID NO: 25

SEQ ID NO: 142 - protein, 235 aa, Medicago truncatula
MSLFNAYSICEIGKDAAGIAGNIFAFGLFVSPIPTFRRIMRNGSTELFSGLPYIYSLLNCLICLWYGTPLISCDNLLVTTVNSIGAAFQLVYIFLFLIYAEKPKKVRMFGLLLAVLGIFVIILVGSLKITDSSIRRILVGCLSCASLISMFASPLFIIKLVIRTKSVEFMPFYLSFSTFLMSISFFLYGLLSDDAFIYVPNGIGTVLGMIQLILYFYYKRSSSDDSTEPLIVSYG

SEQ ID NO: 143 - protein, 250 aa, Medicago truncatula
MSNTLRLAVAVLGNAASVSLYAAPMVTFKRVIRKKSTEEFSCIPYIIGLLNCLLFTWYGLPIVSYKWENFPLVTVNGVGIALELSYVLIYFWYSSPKGKVKVAMITTPVLLVFCITVAVSTFFLHDTTHRKLLVGSIGLVVSVALYGSPLVAMKKVIQTKSVEFMPLPLSLCAFSASVFWLAYGILVRDVFVAGPSLVGTPLSILQLVIYFKYRKERVMEESKIGDLEKGSIELEKVVKVEKIVTNCEQC

SEQ ID NO: 144 - protein, 256 aa, Medicago truncatula
MAETLRLAVAVIGNVASVSLYAAPIVTFKRVIRKKSTEEFSCIPYTIGLLNCLLFTWYGLPIVSNKWENFPLVTVNGVGIVLELAYVLIYFWYSSSKGKVKVAMIAIPILLVFCAIALASAFAFPDHSHRKQLVGSVGLGVSIAMYASPLVVMKKVIQTKSVEFMPLPLSLCSFLASVLWLTYGLLIRDIFVAGPSVIGTPLGILQLVLHCKYWKRKVVIEEPNKVDLPKLVSLENLDLEKGGLEKGNLEKNVTTS

SEQ ID NO: 145 - protein, 248 aa, Physcomitrella patens
  misc_feature (248)..(248): Xaa can be any naturally occurring amino acid
GNITAICLFTSPIPTFIKIVKKKTVADYSGFPYVCTLLNCLLWVVYGLPVVEFQVLVVTINAAGCFIEFLFLTLYLLNAEKKIRMKVMKLLMLVLVSFIAVTVLVLELIEDKKKRKTVIGTLCAVFAVGMYASPLSIMRMVIQTRSVKYMPFLLSLFNFINGLVWFGYAFIGGVDIYIAIPNGLGAASGIAQLALYAFYRNATPRDGDEKGNPTKATNNNFASIELEKNGAQKQSSHVSKSQTNEIVX

SEQ ID NO: 146 - protein, 244 aa, Physcomitrella patens
  misc_feature (244)..(244): Xaa can be any naturally occurring amino acid
MFCPVCCWSGNITAICLFTSPVPTFSKIVKKKTVAEFSGIPYVCTLLNCLLWVVYGLPIVEFQVLVISINAAGCLIEFTYLALYLTYAQKSIRMKVMKVLMAVLITFIAVTILVLELVHDKKKRKLIIGTLCAVFAVGMYVSPLTVMKMVIQTRSVKYMPFLLSLFNFINGLVWFGYAFFGGIDIFIAIPNGLGALSGIAQLALYAFYRNATPRDEDEKDGPTKPTNNSIEMEKNDTYKQSNVX

SEQ ID NO: 147 - protein, 258 aa, Physcomitrella patens
  misc_feature (258)..(258): Xaa can be any naturally occurring amino acid
MGHVDFKVILGVLGNITAICLFASPIPTFINIVKKKSVGDYSGIPYVCTLLNCLLWVVYGLPVVEYQVLVVTINAAGCIIELIYLALYLKNAHKSIRMKVMKVLLAVLILFTLVTVIVLELIHDKKKRKLVIGTLCAVFAVGMYVSPLTVMRMVIRTRSVEYMPFLLSLFNFINGLVWFGYAFIGGLDIFIAIPNGLGALSGVAQLSLYAFYRNATPVVRDRDDVEKAKHMKPNTDSVYVQMGQNGHPPQSEANGAHX

SEQ ID NO: 148 - protein, 254 aa, Physcomitrella patens
  misc_feature (254)..(254): Xaa can be any naturally occurring amino acid
MLSVRVSCNFYSPTFVDIVKRKSVGDYSGIPYICTLLNCLLWVVYGLPVVELQVLVVTINAAGVVIEMIYIGLYLKNAQRSVRVKVMKVLLAVLILFTAIAVLVFVLIHDRKTRKLLVGTLCAVFGVGMYISPLAVMRLVIWTRSVEYMPFLLSLFNFINGLVWFGYAVIGHLDIFIAIPNCLGALSGVAQLSLYAYFRPATPTVRDRNEEKGNSMKWVSSSVSILVEQNDHPPLNQPCGSIEALQICEKASNX

SEQ ID NO: 149 - protein, 252 aa, Physcomitrella patens
  misc_feature (252)..(252): Xaa can be any naturally occurring amino acid
MRVAGNITASFLFLSPVPTFWRIVKSRKVDDFSGMPYLTAALNTCLWTLYGLPFVSFQVLVVTVNAAGAGLEISYIIIYLMYSEGKARMRVVKFFAVMVCGFILMTGLVLGLVDSVDTRKTILGVMGAFLGSLMYAAPLTVMRMVIQTKSVEFMPFLLSLFVFLNSTTWTIYAGVPETDLYILIPNGLGLLLGTTQLVLYAMYRGSTPRKPSLPTFSYKLAVETPPKFAPAPDSKANRPLGPGNQKAPENVX

SEQ ID NO: 150 - protein, 263 aa, Oryza sativa; identical to SEQ ID NO: 60

SEQ ID NO: 151 - protein, 263 aa, Medicago truncatula
MSTAEIARTAVGIIGNVIAGCMFLSPVPTFVGICKKGSVEQYSPVPYLATLMNCMVWTLYGLPMVHPHSFLVVTINGAGCVVEIIYITLFLIYSDRKKRLKVFLGLLLELIFIFLLSFVSLTMLHTVNKRSAVVGTICMLFNIGMYASPLSIMKLVIKTKSVEFMPFFLSLASFGNGVSWTIYALIPFDPFIAIPNGIGTMFAVVQLILYASYYKSTQEQIAARKNNGKGEMNLSEVVVGMSNATVQDNKKITAIDHSSPSAK

SEQ ID NO: 152 - protein, 192 aa, Physcomitrella patens
  misc_feature (192)..(192): Xaa can be any naturally occurring amino acid
GNVFSFIMFFSPLPTFWTIIKRRETGQFSVVPYVATLLNCLMWLFYGTSSVAGLMLVLTINAAGVVIESIYIIIHVLFGDFESRKRTGCYFLGIMVLYTIVLCCVTQAVEVNDRVTVVGAICVVIGSIMYSAPMTVIAQVIRDKNVANMPLFLSASSLINSVVWTTYGILVEDVFVIVSNAFNVDTLNVFFX

SEQ ID NO: 153 - protein, 250 aa, Chlamydomonas allensworthii
  misc_feature (250)..(250): Xaa can be any naturally occurring amino acid
MGASGNMLLDTVVPGMGAVISILMYLSPLKAVLKAQREKHLGDLNPIPFSITIANCIAWLGYGLLKKDPFVCAPNAPGVLIGTYMSLTAHGLADEGAKERIRFVVCLAAAIFPFLGVYTSFFAPSAVVQQGVWGMAGNIVCLVYYAAPLSTMWDVIRTRNSSSILVPLTMMNTLNAALWTTYGVAVADPYIWAPNGIGLALSVMQIALRLVFPARAASALPSHAHHSGGSGASKYARLDEEVPLGGAGHX

SEQ ID NO: 154 - protein, 231 aa, Chlamydomonas allensworthii
MTAWTGRRALLDDDDEFDFKKLFLHHLAPGLGCIIAFLMFVSPLKTVLQIRANKHLGDLNPLPLVAIIANCAAWLIYGCINADPYVITANEPGLLLGIFMTVSCYGFADPKARDVMLKALMFFAVLLSAVGIAIALFIEEDETASKTAGYTAVFILLCYYGAPLSTMAEVLRSRSSASLFWPTSLMNTINGLLWVAYGTAVSDPFIAVPNAIGAAFGVIQIGLINIYPAKK

SEQ ID NO: 155 - protein, 248 aa, Chlamydomonas allensworthii
  misc_feature (248)..(248): Xaa can be any naturally occurring amino acid
MGVFTEHVVPIFGNILACAMLVSPFPAVLRLRAAGKLGDINPLPYPMTVVNAAGWVAYGFAVANPYIFPANVVGFLAGVFFTFTAYAAAPKQVQDRITGIMVAASAHYIMLGLIACFALSHTAGARMWGTSAVVILMLYYFVPLSTMVQIVKTRNAASIYPPLAITAIANGLMWSIYGFAIMDINLWLPNLFGSIVGVIQLLLRLVYGAKPTAAAAGGGALAVGAGAVAADDEETAAFAKTGAEPSGX

SEQ ID NO: 156 - protein, 221 aa, Caenorhabditis elegans
MFLEIFRVWIGFFSISFIFLPIYLVLDWKKRGTSDGFSAVVLIIPGIIQSFWLRHGWMTNEWTHIIINTVNLTALSFYISAYAYYQSNRKNLIGQLISAVIIVKCAFFYVDSHDAEHTNSAMGTVAAGAQILGLGGRVYEMRRAVKLGTTEYIPAFMQFAVSALMAQWLLFGIVTGNQFIANANVAGLTASAITLYLYFKYPPLTWTVPLFNIPPQNAKKE

SEQ ID NO: 157 - protein, 224 aa, Caenorhabditis elegans
MFLEIFTVWLGIFSIGFTFLPMFMVLDWHKRGTADGFSSVNFVLPMLVQSFWLRHGYMTNDQTNIIINSINLVFFAFYVSAFAYYQPKRKYLIGQIVAAALAVKVAFAYVDTHDSASINDAMGSMAAGAQIFSLVGGIYEIKRAISMGTTEYIPAGFQFAIFTLILQWLLFGILHGNQFIAISNAAGLLVNIATLALYFFYPPLTWTVPIFNIPPQNKDAKKVE

SEQ ID NO: 158 - protein, 225 aa, Caenorhabditis elegans
MTTSLGQTILPYLSFTALSSTVAFFLCGLQICHRIKTRGSSEGTSPAPFLLSFLSCGLFIQYGLLKDDDVITYCNGIGCFLQACYLMYFYYMTRNRRFLNKVISIELGIIGIVVYWVAHSTNSHLTKTTYVGNYCIFLNICSVAAPLFDIGKVVRNKSSESLPLPLCVACFVVCLQWMFYGYIVDDIVILVPNVIATVISILQLSLFIIYPGAPAGVLPQKYEHI

SEQ ID NO: 159 - protein, 239 aa, Caenorhabditis elegans
MEIDLGTVSASRLFAMYTSNLVWSLFLTSTALHAVALITSPVQAVHKWVRRQSSDSDTPIPYICAVIGSALWLRYSIFLRDTKLILLQTYAVSMQLFFVIALIFYRTKRRKLIRLMTGIAAALSLLFLYIGNMNDEDGKEFTGRIASGAQIAGSLVCPYLIYKAVTSKCIDFVPLAPVVFTWVMELHAIVYSIGIDDFYMLLANVIFFCMDGSLLSMFFVYPTEKKKKNLKSSPIPTVM

The invention claimed is:

1. A method of inhibiting the expression or activity of a SWEET transporter in a plant cell, the method comprising transforming the plant cell with an expression vector, the expression vector comprising a nucleic acid sequence coding for one or more polynucleotides that form a double-stranded RNA (dsRNA) to inhibit a nucleic acid sequence in the plant cell coding for the SWEET 12 transporter, wherein said dsRNA reduces sugar efflux out of the plant cell, wherein the plant cell is from or in soybean, tomato, alfalfa, potato, pea, wheat or maize, wherein the reduction in efflux of sugar out of the plant cell increases pathogen resistance of the plant cell to *Golovinomyces cichoracearum*.

2. The method of claim 1, wherein the SWEET transporter protein is located in the cell membrane of the plant cell.

3. The method of claim 1, wherein said sugar is glucose.

4. The method of claim 1, wherein said sugar is sucrose.

5. A plant cell comprising an expression vector, the expression vector comprising a nucleic acid sequence coding for one or more polynucleotides that form a double-stranded RNA (dsRNA) to inhibit a nucleic acid sequence in the plant cell that codes for a SWEET 12 transporter, wherein said dsRNA reduces sugar efflux out of the plant cell, wherein the plant cell is from or in soybean, tomato, alfalfa, potato, pea, wheat or maize, wherein the reduction in efflux of sugar out of the plant cell increases pathogen resistance of the plant cell to *Golovinomyces cichoracearum*.

6. The plant cell of claim 5, wherein the SWEET transporter protein is located in the cell membrane of the plant cell.

7. The plant cell of claim 5, wherein the sugar is glucose.

8. The plant cell of claim 5, wherein the sugar is sucrose.

9. The plant cell of claim 5, wherein the plant cell is in a plant or part thereof.

10. The plant cell of claim 9, wherein the nucleic acid that inhibits the expression of the SWEET transporter in the plant cell is expressed in a part of the plant selected from the group consisting of root, stem, leaf, seed, flower, fruit, anther, nectary, ovary, petal, tapetum, xylem and phloem.

11. A method of inhibiting the expression or activity of a SWEET transporter in a rice plant cell, the method comprising transforming the rice plant cell with an expression vector, the expression vector comprising a nucleic acid sequence coding for one or more polynucleotides that form a double-stranded RNA (dsRNA) to inhibit a nucleic acid sequence in the rice plant cell coding for a SWEET 12 transporter, wherein said dsRNA reduces glucose efflux out of the rice plant cell, wherein the reduction in efflux of sugar out of the plant cell increases pathogen resistance of the plant cell to *Golovinomyces cichoracearum*.

12. The method of claim 11, wherein the SWEET transporter protein is located in the cell membrane of the rice plant cell.

13. The method of claim 11, wherein the sugar is glucose.

14. The method of claim 11, wherein the sugar is sucrose.

15. A rice plant cell comprising an expression vector, the expression vector comprising a nucleic acid sequence coding for one or more polynucleotides that form a double-stranded RNA (dsRNA) to inhibit a nucleic acid sequence in the rice plant c cell that codes for a SWEET12 transporter, wherein said dsRNA reduces glucose efflux out of the rice plant cell, wherein the reduction in efflux of sugar out of the plant cell increases pathogen resistance of the plant cell to *Golovinomyces cichoracearum*.

16. The rice plant cell of claim 15, wherein the SWEET transporter protein is located in the cell membrane of the plant cell.

17. The rice plant cell of claim 15, wherein the sugar is glucose.

18. The rice plant cell of claim 15, wherein the sugar is sucrose.

19. The rice plant cell of claim 15, wherein the expression vector is expressed in a part of the plant selected from the group consisting of root, stem, leaf, seed, flower, fruit, anther, nectary, ovary, petal, tapetum, xylem and phloem.

20. A method of inhibiting the expression or activity of a SWEET transporter in a plant cell, the method comprising transforming the plant cell with an expression vector, the expression vector comprising a nucleic acid sequence coding for one or more polynucleotides that form a double-stranded RNA (dsRNA) to inhibit a nucleic acid sequence in the plant cell coding for the SWEET 12 transporter, wherein said dsRNA reduces sugar efflux out of the plant cell, and wherein the plant cell is from or in soybean, tomato, alfalfa, potato, pea, wheat or maize.

21. A plant cell comprising an expression vector, the expression vector comprising a nucleic acid sequence coding for one or more polynucleotides that form a double-stranded RNA (dsRNA) to inhibit a nucleic acid sequence in the plant cell that codes for a SWEET 12 transporter reduce sugar efflux out of the plant cell, and wherein the plant cell is from or in soybean, tomato, alfalfa, potato, pea, wheat, rice, or maize.

22. A method of inhibiting the expression or activity of a SWEET transporter in a plant cell, the method comprising:
transforming the plant cell with an expression vector comprising a nucleic acid sequence coding for one or more polynucleotides that form a double-stranded RNA (dsRNA) to inhibit a nucleic acid sequence in the plant cell coding for the SWEET 12 transporter, wherein said dsRNA reduces sugar efflux out of the plant cell, and
selecting a plant having reduced efflux of sugar such that resistance to *Golovinomyces cichoracearum* is increased, wherein the plant cell is from or in soybean, tomato, alfalfa, potato, pea, wheat or maize, and wherein the reduction in efflux of sugar out of the plant cell increases pathogen resistance of the plant cell to *Golovinomyces cichoracearum*.

* * * * *